United States Patent 12,059,441 (PROBIOTIC BACTERIAL STRAINS THAT PRODUCE SHORT CHAIN FATTY ACIDS AND COMPOSITIONS COMPRISING SAME) - sequence listing, part 2

SEQ ID NO: 24 - DNA, 3497674 bp, Roseburia faecis (residues 1,748,838-3,497,674 of 3,497,674)
ccatggcacagtttccggcaccccgccccatggacatcatggtagcatctaaaagactgacaccgtgggagagtgcttcaatcgtgttggcaaaggcaagctgctggttattgtgtgcatgcataccgatgtatttgccgtatttttctccaagttcggtgtatttatctgcaatcgcacggatctgttccgggtaaagagcaccgtaactgtccacgatataaatgccatcggcgctgctttgaccgaccatttcaagtgcctggtcaatatcggattctttggcattggagattgccatgatattacaggttacctcgtagccctttgccttggcatcttcaatcatttcgattgcagcaggcatctggtgcacgtaagttgccacacgaaccatgtcaattacactgtcttttttgtcaatgatatcttttttgtaatcgcagcgtccgacatctgccatgacggaaatcttcatatcggagttgttgtcaccaacgatctcacggatggattcttcatcacagaacttccacttgccgaatttatttacgtcaaacagctccttggaagctttataaccaaactccatatagtcaacgccggcctttacattggtgcggtagagtgcgttgataaagtcatcggagaacataaagttgtttacgagtcctccgtcacgaatggttgcgtccaatacacgaatatcggaacgtgctgtcattaagtctcctttttgagccatttttgtttcctccttgtggttctttgaatcttttacactttaacgctttgacgcgtgtgagtatataataacacaattcgataaaaatgcaagcaaaaactttacttttttcctgtctcctaatataattaaattgggtgaaagcccgaaggaggataaaatgatatacttattaggaacatatgaacacgcactggttgcttttatcggtgttttatttgcttttgcagcgacctgtattgcaattgcaaaattaaacgggtatctgccgaaggacatgggaagacagtatgcacatgatggagctctttccgcaggaaaaccaagaggtgcgggtattatttttgtgttgacttttgttgtttccgcattgttgtttggcaaaatgaataaggaaattatcatttatctggtgctgatcgtcatcgaaatgttcaccggattctttgatgatgccgcagaaaaaccatggggagagtatttaaagggaattctggatctggcagtggcagtcgttgtagccatttcctatctgcattacaattccagtgagatcaccattgccattacgggaacgaccatcgtgattccaccggttgtatttgccattctgaccgttattctggtgtgggtttccatcaatgttaccaactgttcggatggtgtggatggattgtcgggaacattgaccattatcacgttgatgagtgtgtttgttcttgacaatattttaaaagtcaatgattctttcaattactgtattttactgtttgcggtatgtctgctgggatatctgtggtataacgcaacaccgagcaagcttcttatgggagatgccggatcacgtgcaatgggtatttttattgccattgcggtattgaagatgcacagcccgtttatgtacctgctggttgctgcggtacttatcgcagacggtggtcttggtctggtaaaggtttcactgcttcggtttttaaagatacatattctaaagaataccatcacaccgattcacgaccatgtaagaaaaaagggtgggtggtccaatgcccaggtggtatttcgatttgccatcattcagattgtaatttcacttgcagcaatttatctggttatgatttaagttgtagttataattggaggctttatgcgttttgtttccattgaagatgccagaccgggaatgtgtcttgcgtatgatttatatgattccatgggacgtaccatggtgggaagcggctgtgaactgacggcttcctatatcaataaactaaacgaatacggatttagcggtatctatatcgaggatgaacagtcgaaagatatctacatcgaagcaacaataccggaaaaactgcgccaggaagggtttaaatgtgtgcaggagaatgatattgaccgttgtgccgagattgcacaacagattgtggagaatcttttgtccagggaaaatgtgtgtctggatatgacggatctgcgctcatacgatgattacacatatgcacattcggtgaatgttgctgtgctctgctgtgtgatcggtatggggatgggaatgagtgaacgcgatctgaattatctggttacagcggctcttttgcatgatctgggaaagcttgccattccaaaggaaatactaaacaaaccgggcaggctgacaccggatgaataccagctgatgaagacccattcgacccgttcgtaccagctgctttcgaagcgctggaatatttcggcgcatatcaagcagacggtacttcttcatcatgaaaatgtagatggaagcggatacccacaggggctgatgggagatgaacagtcactctccgtaagaattgtacatgtggcggatgtgtatgatgcgctgacatcaagacgtccgtataagaaaccatattccccttatgaggcggtagagtatctcatgggagcctgtggcatcatgtttgacaaaaatgttgtggaagtgtttatggagcgggttccgctgtttccgagagggacggaggtaaatctgtcggatggacgtaagggcctgatctatgaaaacaaaggaccgcataatctgcgaccgattctgaatatgccggatgggaccaaactggatctgatggaaaataaaaacttaaatgttacgattcttccaccggaatatcttgatacggtttctccagattcggaagagccggaaagaaagaagatggttcaggaaactgccagaaaaaaaatcatgatcgtagatgatatgaagaccaatctggatgccatgcgtggaattctcgaggatgagtataccgtcattctctgtaaatgcggaaaacaggcattgcattatctggaacacaatgagtttccggatctgatcattatggatgttgatatgccggaaatgaacggaatcgagactaccatgagagcaaacaagctcacagggggcaggataccggttctgtttgtcacggccatgtgtgatgcgcatacggtaatgacctgtcggagactgcatgcggcaggatatattgtgcggccatataaagccatttatatcaaatccgaagtagagcggatatttagtggttggaggtaaaacggatatgggactggttttccatctgatctgtcttttttttacactgtttgtattacaaagttatgtcagcagcgggtttcacgcaagggaacaccggctgctgccgttggttttagggctgattgcattgaacagtttttatcgcattacctattatgttacgggagaggcaaagacacttcgtatactgacagatttactggccattcacatgctgtatcttatgattcattatgtgggtgattttatgaaattccagttgaaactcaggacggaagtgattttgttctgcagtctggtgctgtttaattccatgttgattatacgtgctgcgcagcgcgagacgtatcaggatgcgtttcggattgcgctgctttgttatacgggaattcttctggggctggctacttatgtgagagtgaaaagcgaggtttctgtctgggagggacatgtaaatgatatgttgtatcttggcatggcacttccgggagttgcaatgttgtttcgcgcagttacgccgaaagcggaagaatttctggtgccgggagcttttgaaatttcctgtctgattgtcttttatctgatgatgacgggaagattatccaatgtgacgaacattatccgggaaaacttttataatatcagtgatatccctacgtttttgtttgacaacagaatgcgttaccgggatgccaatgccagtgccagacgatggtttccgaaaattgtgggggaactgacggacgatccgcaggagtaccctttttataccaaaatgatgcgttggagtaaagacccggatcaggattatgtggttcagtggaaagaaagttattgcaggtgtcagctgcatccggtctgcagtgaaaatgtggtgagaggatatattcttactctgctcgacatcacacagcaaaagaaggaaacggttctgatggaggatctgaaaaagaaagcagaagaacagtcatttttaaaaagccgttttctggcatcggtcagtcatgatctgcgcagtccgttgcatgcgattatcggaggttcggacattttaaaaaggcagaatcttccggatgagagcaaaaacattcttgaatatatccgtgtcgcgggaaataatctgcttgaacaggtggataccatccttgcatattcgaagctggaagcaggaatgttgacgctcaaagacaaaacatacaatttttatgagatgatcgaggaacaggcccgtctttgtctgctgaatatccgggaaaaagatatcgtatttaccgtgaggtttctggaccggtttccggagcaggtaagtggggactatttacgtgtggcacagatttttcagaatattttatcgaatgcctgcaagtttacggaacagggaacgatcacgctgtcgcttcactgtaaaatggaagaaggacaggtatggtttgacggctgtgtggaagataccggtgtgggaatgacaaaggaaaaacttgcacaggtatttgcggaatatgtctcgttttccgaggatatgggggtagagggctttggcctgggtctgtcaattgtcagacagctcgtagaaatgatgcatggctgggtaagagcagagagtgatccgggaaaagggacacgcgtatcttttggattttatcagaaacaggttccgactgagatatcagagccgggaaacatcggacaggaaattttaaaagaacagagtaatccgcaagtcgaagaaatacagccgaactgggtttatccgcgggcacgtgtccttctggtggatgatatggaagcaaacagggtgatttttcaggaacttgcggctccatggaagtttatactggatctggcggtgtcaggagaagaagctgtacagatggtaaaagaacgggaataccagatgattattctggatcagatgatgccgggaatgtccggatttgagacggcggatcagatacaaagatacagtcatgcaccgcttgttcttatgacagcggatatttctgatgaagtcagaagccgttccatccggcatggatttaccgattttatgccgaaaccgatccggctgcagcggatgaggcaggttttagaaaccggaattccggtaagatacagggaacttccgaatccggtcgatgcgtcaaagaaggagaaagctacaggacagaggaacgctgcgaatatccgcacgctggaatcttattggaaagaggtggagagtttacttccgaaacttccggagtttgctcagcgggatctgcatatgtttcagacaaaagttcatggaatcaaaggtatcagccgccagattggaaaagaggagattgcccagcaggcagaaattatggagatggcggcaaagaccgaaaaccgtgcctttataaaccggaatctgcatatcttcttagagcagctgcgggggacggtgaaagaaataaaacaggagaccaaagatttaccggagagtggtcacatacttcggcagggaaaactccccatgatggatgaagagcagcgacgactgtgctggaaagggttaaagtatggatttgatacctatgatattgcacagattgaggagaatataaagatactttccgaacatgaattaccgccggaagaaaaagaaaggcttcccgtggtaagggaagcctatgaaaatctggattatgaaattggaagcaaagcctgtatgttttagacacggcggcgcaataacgcatagaatttttcaatatggaaaggttttccctgaaccgcctggactttcaggcggttttcttcattgaaacctaccagaatgttgtgattggcctctgccaggtaatccataataccgtcaatatcggatttggtatttttcggacagtttacatacatatgtttgtttgcggtaatatgcatggtataagagatgctgaaatgataccagagcattttgtggagcgtcgaatgtttatagatccacagaatctcctgaataggcacaatggcatttccatatggtgatgtcatgataaaataatgttcggtaataaacatatcctccgttgccagctgtggaagtgttgcaagttcttcctcggcctcggcgagaatctgacccggatgtccgaagacgatcaggttctggcacggtggggaaagcaccgggaaccggatatagaccatacagatcagaagatacaggacggtataaatcatggaaccgaaatacgcgaagaataaaatgcgcgtcgtggttaaatgatagtcaggctcactgaaataatacgaagacagctgattgcggataccggtttcggtccagttcaggtcagaggaaagctgggacaaaagtgccagataagattcttttcctttgacgatccggccggtgacggtcagacggtcgatcgtagggagtccttcctcacatgtatgcggggtaaggagaatgatgctgcaattatttttctgtgtggtgtaataataatatccgcgggtctgtccataggtttcacaggtatatccgctgaatttcagatctgtgaaggtcatgcgcacataacggtgatggttcttgtaggcgtccgcaattttggtattgtcggaaagctgtgcagggcgcagcatggcacccagtggaaatacgatccagagaactgcaagtaaaaccagatatatcattggagaaaaaagtcttctgcgatagaaggcctgaatatttttggaaatataatgttcgtagttgtcaggcatggaaaatcctttctgtagttcaacttatgcattcagtataaaggtttcgggaagaataatcaaccttgcttttgccataaaaacttgctaaactatgatacaaagcaggaggaaaagaatggacgcgtatacgggttttgcgcaggtttatgacctgtttatggataatgtgccctatgatgaatggtgtgcatatatttgtgagacattaaaaaagcatggaattgcagacggaccggtgctggatctgggatgcgggaccggagaactgacccggagactggctgcctgtgggtatgatatgaccggtgtggatgtttctgtggatatgctgcagaaagccatggaaaagcagacagatccgccgattctttatctgctgcaggagatgcagacactcgaactggatggatgtgtgcgggcagtctgctgtacctgtgactgtgtcaattatgtgcttgagccacaggaactttccgatgcattccggcgggttgccgcctgtctggaaagcggtggagtatttatctttgatatgaataccgcctataaatacgaacagcttcttggagatcacacatttgcggagagcaggcaggaaggaagttttatctgggaaaattattatgacgaagagaccagaatcaatgaatatgacctgacactgtttatcccggaagcgggagagctgtaccgccgatatgcggaaacacactatcagagaaattataaggtggaacagatagtggactttctgcagcaggcgggactggtctgtgaaggaatgtatgatgattacaccgacgccggggtcaaagccgacagtgagcgtatcacatttgttacaagaaaagaataaaggagaaatgatacatggcagattatattgttagagcaaccgcagcaggtgccgcaatccgggcatttgcaattacatcgagggatctggtggagaccgccagacaggatcacaatacgtccccgatcatgacggcagccttgggacgtctgttgtccggcggtgcgatgatgggaacaatgttaaaaggggaaaaggatcttctgaccctgcagattcagtgcagcggtccggccaggggacttaccgttactgcggacgccaatggacatgtcaagggatttgtcaataatccgattgtggaacttccgccaaacaaagacggacatttaaatgtagggggcgcgctggatctcggtattttgagcgtcatcaaagatatgggattgaaagagccatatgtgggacagtgtcagctgcagacaggagagattgcagaagatttaacctattattttgcaacttccgagcagattccgtctgcggtaggattgggcgtgctgatgaacaaaaacaacacggtgcgtcaggccggcggatttattattcagcttatgccgtttacgagtgacgagatcattgaaaaactggaaaatcgtattgcagagatcgattctgtgactatgatgctggagcgaggactgacaccggaaggaattctcgaagaaattctcggagatttcggcttggaaatcaccgacaaaattccggcagcatttgtctgtgactgttccaaggagcgggtatcccgcgcactttcgacgctcagcaaaaaagatctcgatgacatcatcaatgatggggagagcatcgaggtaaagtgtcagttctgtaataaggcatatgaattttccgtagaggaattaaaggagttgagaaagtgagacagggatttgtaaaagcagctgcagtcacaccgaaaattaaagtggcagatacaaaatacaatgcagaactgattctggatatgatgaaagaaagtacccggcagggagcaaagattgtagtttttccggaactttgtctgactggctatacctgtcaggatctgtttttgcaggaacgtctgctgcagggcgcaaaggatgcgctgatgaaattagtaaaagagagtgcttcactggacgccatttttttcgtgggacttccctttgaaatccttggaaaattatacaatgtggcggcagtgttttcccatggagaagtgcttggacttgtaccgaagagttatctgccgaattacaatgaattttatgaggcgagacatttcgtatccggagcagagcttgcgacagaggtggttctgccggacggaagctgtgttcctgcggaccgggatctgctttttgtctgtgagcagatgccgaaactcagaatcggtgtggaactgtgtgaggatctgtggacaccgaatccgccgagtatctcccatgcactggcgggggcgtctgttctggtgaatttgtcggcttcgaatgaactgaccggcaaagacagttaccgcagggaactggtaagtggccagtctgcacgtcttcttgcggcatatatttatgcgtcagcgggagagggagagtctacacaggatctggtgttctccgggcacaacatcattgcggaaaacggacagattcttgcggaatccaagcgttttggacatggcatcctgtattcggagattgatgtggaacgtctctgtgcacagcgccgcagaatgacaacttttgtcactgaggatcagacacataccgagattctgttctctttaaaaatagaagaaacaaaactgacgcggtttattgatccggcaccgtttgtgccaacagacagacagaacagggaaaagcgttgtgatgaaattctgatgattcaggcaatgggactaaaaaaacgtctggaacataccggagccaatgctgtggtaggtatttccggaggactggattcgacgctggcactgctggtgaccgtgcgtgcctttgatctgtgcgggcgggatcataagggaattacggccgtcaccatgccgggattcgggacaaccgaccgcacatatgacaatgctgtcaaactgattcaaagccttggggcagaatttgtggaagtggatatctgtcaggcggtaaatgtgcatttttcggatatcggacaggacccttcggtgcatgatgtgacatatgaaaattcccaggcgcgggaacgcacgcagattctgatggacattgcgaacaaaaaaaatgcgcttgtgatcggaaccggagatctgtcggaacttgcactggggtgggcaacgtacaacggagatcatatgtccatgtatgccgtgaatgcttctgtgccaaagacactggtccggcatctggtgcgttattatgcggatacctgtgaggacaagcagctttccgatacactgtatgatgtattggatacacctgtttctccggagcttttgccgccggaagacggaaaaatttcacagaagaccgaggatctggtaggtccgtatgaactgcatgatttcttcctgtattatatgttgcgtcagggattttcccctgcaaaaatttatcgtctggcaaaaatcgcatttgctggaacctatgaagctgcatttattttaaaatggctgaaaacgttctgccgcagattttttgcgcagcagtttaaacgttcctgccttccggacggcccgaaagtcggatctgttgctgtttccccgagaggagatctgcgtatgccgagtgatgcgtgtgcaacattgtggatggaggaactgaatacgctttcttagaaaaatacattttttattcgaatcttaaccgccattatgctataatgaaacatatggatgcaagagataaggagaaagaagattcggatgaaaaaaacattgtatatcataagagatatagccattaccgtcgggattcagctggtgtgttttatggtctgtttgtggatacaaaacagtactgtggaaaatgcgctgatcccggcagtatctatttttggagtctttctgacttctgtgatcacaccggggtatctgtatggtgtggcagctgcaattctcagcgttcttgaagtgaattttgctttcacatttccattttttcactttaatttttccataccggagaatatggcatcggcagtgatcattatactgatggctttgattacctgtgggtttaccaccaaaataaagtataataaaattctcgaagcagagagagaaaaagaaaaaatccgtgcagacatattccgtgcggtttcccatgatcttcggactccgcttaccacgatctatggctccagctcggcgctgcttgatccggataatgattttacgaaggaacagcggacaaagatgctgcaggacatccagcaggatgcacagtggcttttccggatggttgagaacctgctttcgatcacaaaacttgacagtggaaaagtaaaaatcattaagacacctacggttttggatgagctgattgattcggtgattttaaagtttcataaaagatatccggatcaggaggttgaaattgatattccagatgaatttgtggtaattcccatggatgccatcctgatccagcaggtgttgatcaatattttagaaaacgcggtgcagcatgcaaagggaatggtgcacctgggactgaaggtatttcttgtggcggacaaagccgtatttgaagtacaggatgatggatgtggaattccggaagaaaaattaaaatctgttttttacgggagtcatgaggcatatgaggtatcttccgattgcaaacggagcaatgcaggaataggactggcagtgtgcgcaacaattatcaaagcgcacggtggaaagatcaaggcagaaaataagaaaaatggaggtgcacttttccggttttatctggatatggaggagaaggaacaggcatgaacggaaataaatataagattttaattattgaggatgatgaacatattaacaatctggtggctacacttctggaggcaaacggatatcagacattatcggcatattcctgcgaagacggaatgatgatgtatgcttctcacagaccggatctcgttgttttagatctgggacttccggatcaggacggaatgacttttttaaagcggttacggaaagattccctgacgccggtgattgtgctttctgccaggtcagatgaaaaagataaagtggaggctttggatatgggagccaatgattatgttacaaaaccatttggctccaatgaatttcttgcgcggatacgttctacgcttcgcatgacaacacatcgcatgcaaaacggaatgtttccgggtggaaaatttaaggcctccggtctgaccattgattacgatgcaagaagagttttcttgcataaaaaagaagtgaagctgacacagacagagtacaatatcattgcagcattgtcggaacatgcgggaaaggttatgacatactcagccattatcaaagagatctgggggtataacgatgagggcagcatcaaaaaactgcaggtcaatatggtaaatatccgtaagaagctgggagccagaccgggagaaaaaaattatattgtaaatgaactgggcgtagggtatcgcatgtgcgaggcggatgaggaaaccttatagctgtaatttagaggagatagataatacaaaaagaggaaaaacgttttttcgtttttcctctttgattttttgctttgtttattttattatgtaaaataaattataagagctgaataccatgttcctcgcaggctgcaattgtttcttccggccagagagaactctgcacttcgccgatatgagctttgcgaaggaagaacatacagatacgggactgaccaattcctccgccgatggtataaggaagtgttccatcgatgatggatttctggaatggcagatccttgcgttccggacagccggctttgtcaagctgggaaatcagagcagttttgtctacacggatacccatcgaagataattccagtgcaatatcaagaaccggataataaacaagaatatctgcatttaaagcccagtcatcgtaatccggagcacgtccgtcgtgcggttcgccagactctaaggtgtcaccgatctgcatgatacatacagcaccttttgccttggtaatataatactcacgttccttcggtgtgttgtccgggaacagatcctccagttcctgggaggtgataaagaaaatttcctttggaaggatcagatcaatgtaatcatactggatggccatatactgttctgttttgcgaagacacttatatacggtacgaacggtctcttttaaatagtccagattacggtcttctttatgaatgattttttcccagtcccactgatctacgaaaatagaatgaatgttgtccgtactttcatcgcggcggatggcattcatatcagtgtagatgccttctccgacctgaaatccgtattttttcagggcgtaacgtttccattttgcgagagaatggacaacttcggcatttttatcgtcctgctccttaataccgaaagtaaccgggcgttcataaccgtttaagttatcattaagaccggttgccgggtctacaaaaagaggagcagaaacacgtgtcagatgcagtctctgcgccagcagtgcctgaaagaaatctttgactgtcttgatggcaagctgtgtgtcatgaagattcagttctgatttgtattgttttggtaaaataagattttccatgagatctcctttgttatattgttactctgtgtttcattatagcacatgaactatggaattcaagtcaaaaaggtgttagaattaggatatgattttacagaatgaaatggagaaaagcagatgaaaaaagaagatttaaccgttccggcaatttttgcggaggcgataggaatgatccttggaattgtctatatcggactgcagatctattatgggattgcctataaagttgcgccatataaatttatctgtaacattgcaggagttgttctgatctatgtgggactcagcctggtaagctgtcaaccggaaaaaataaaccggcttccgaaagaggtgtgtgtgggaaaggtgcgtaaatattccatccggatgatccggctggtaaaactggtgtttatcatcggtctgatggttccgtgtgtgggagatgtgatcgggatcgaactcaaggacgcgtacagtctgctggtgattgccgccatccttgtgatcaccgtgttttatgagtaccggatcattcagctgcttcgaaatgatcatcatgatcaggggcagccataaggcgcgccgctttctgatcgcgccatttcgttcccaggcggaataaggaaaagcccaaaacgagagaaacaatcgtaaagagaaagatgataattcccagaagatccgtttctttgagattgttcagtagcggtccgatgatggttccccagaagttgaacaggatgtggaagaacattgagaaatagatgcttcctcctttttcacagatccatcccagtacaagaccgagaacaaatgcataaattccctgaatccagttcatgtgaaagattccgaagagaaccgcctgcatcaggttggcagcccagaacggaagtgcccgtcggaccagacgcatggtgacgccgcggaaaaccagttcttcgcagacaggaccgagaattacggcatagataaacatgaacagtccgatgtcggagtctaagcctgcggtttccatgagtttttcgtactggctgagccagttcgggaaaagaagagataccgcagaagtcagataaccggaaaagaactgcatgccgggaatcagaagaatgatggataaaaactgcagaggatgaaacgtgagggatggttttggaagataattgcccccacaggagcgataataccatattcccatgaatacgatgcaggttacggtataaatcagcatgatgcatgcattaaactctgtattggtcagaagtgtttcgatggtatcggcatcaaagcctgtgctctgggaggccggacacagaaacagagctgcgattccgaacataaaaaaagaagccagtatctgtgcagctgttgttgttaaaattggcagaaagccggaaaaaaaataaccgatctttttcatatcatagattctccattcgttttcgtgtttggtaaactgtactaaacattatagcataacaatggggtaatgcaagaaatctgtttactttaaaactttaatatgataaaatacagacatgatttttggaaggaaagagggagcataatgagcaagaaacttaaaacagaggcagtagatcatctgtttgatgcaattttatgtctgcagaacagagaggaatgttatacattttttgaggatgtgtgtacggtcaatgaattgctttctttatcacagcgatttgaagtggcgggaatgctgcgggatcagaagacataccttgatattgcagaaaagacgggggcgtctacagcgacgatcagccgtgtcaatcgttctctgaactatggaaatgacggatatgagatggtattcagccgtctgtcacagaaacatccggaacaggaatagaaaaaaggcacggatgcgtatctgcatctgtgcctgaaaatacaatcatccgtttggattaaacggtgtcttttttggaggattcctttttggaattctcttttttatttgttttactgttttgactgttgatattgtcgataacactttcgataatcatctttttgatgtatacgtcgtagctgagcagacagataaaactgaaattctgcagaaattcctgatcattttccggaaatttccggaacgtctcacgggagagtgcatatttttttccgagatcttttaataatttctcggactcggtgctctctaaattaaaaacctcgttatagacatcttccatattaaatccggctttgttgccaaaataatgttccgtcaggggatttaacagggactggatgtcgttgatgctgagcagattcttaaaatagtaaatgaataacagggtcagcacatgctccttggaatattttttcttctccggggcagggagcagattgtttttggcataattgttgatcattgttttggtcagaattttatcatcttcatagcgtttgcaggcttctaactgctcgtccataaaggtcgtgacctgatccatatataaaccgatatttggaatgtcttccgttttgatgtaatcgattgaaaccagtttcttctgcagtgcagcaagaaattcttttacttcgttgtccatattttcacctcatatcacattatatagtaataaaaactagatgacaaggcattttcatgcttttttcaaaaaacaaaagaatgtatgttctattcggactatctatgatataatgagacacacgaataatgaattatggaaagagacggagaaacgatatgagcttattagatgcactgaacgaaccacagcggcaggctgtgatggcaaccgacggaccgcttctgattctggcaggtgccgggtccggaaaaaccagagtattgacacatcgtacggcatatctgattgaggaatgcggggttaatccctacaatatcatggcaatcacgtttaccaataaagcggcaggggagatgcgggagcgtattgaccagatggtgggatatggttcggaaagtatctgggtgtgcacattccattccacctgtgtgcgtattttgcgcagatatattgacaggctggggtttggcaccaattttaccatctacgattccgatgatcagaagactctgatgaaggatatctgcaaacgtctggaaatcgatacgaaaatgtacaaagagaaaatgtttctttctgctatttcctccgcaaaagatgagctgatcgatccgatcgaatttgagacgcgcgcagcaggcgattatgtgaaacgaaaacaggcccaggtttaccgggaatatcagcaggcgttaaagcagaataatgcattggattttgatgatctgatcatgaaaaccgtggaactgttcaaactggacaaagaggtgcttgcctcgtatcaggatcgtttccgctatattatggtggatgagtatcaggataccaataccgcacagtttgaactgatccgtctgctggctttaaaataccagaatctttgtgttgtaggtgatgatgatcagtctatctataagttccggggagcgaatatctacaatattctgaattttgaacatcattttccggatgccacagtgatcaaactggagcagaattaccggagcacgcaaaatattctggatgcagccaatgctgtgattgccaacaatcaggggcgaaaggaaaaacgtctgtggacggacaatggagctggggacaagatcacctttgagcagctggatacggcggcagaggaagcggattttgtggcaagggatattgcccggcgggtacgcaaaggagagtatcagtataaagactgtgccattctctatcgtaccaatgcacagtcccgtctctttgaggaacgttttattacagcaaatattccatataaaatttttggcggcgtaaatttctacgcccgtaaggaagtgaaggatctgctggcatatttaaagaccatcgacaatgggcaggatgatctggcggtgcggcgtatcatcaatatcccaaaacgtggaattggtgcggcatcgatcaacaaagtggcattgtatgcccaggagcaggagatcagtttttatgatgcgctctgtgtggcagaacaggtaccggggctgggcaaagcggcagcaaagatccggccgtttgtgttgtttatccagtctatgaaagcaaaggcaaagctgctttccgtggcagatctgctgcaggaagttattgaaacgaccggttatgtcagagaactcgaagcagagggaacggatgaggcagaggcaagaatcgaaaatattgacgaattgatcagcaaagctgtggattatgcggagggggaagaagctccgaccttaaacggctttctggaaaatgtcgctctggttgcggatattgacagttttgacgaaaacagtgactatgtggtacttatgactttacatagtgcgaaaggacttgaatttccgaatgtctatctggcaggacttgaggacggactgtttccgagttatatgtctattacgagtgataactcccaggccgagatcgaggaagaacggcgtctggcatatgtgggaattacccgtgcaaagaaaaatctgacaatcacttccgcgcgtgtgcgcatggtgcgggggcagacacagtatggaaaagtatcccgttttgtcagggaaattccgccggaacttctttccggaaagatttatgagccaaagacaaaggaagaacccatcgaacagtccacatttcagaaggcgcgtaaggcattccggacggtgccgagttatggtggaagcggatatggaaaagaagtgggagagggatatggatcgaccttccgttcctccaaagccacaaaaccggtatatacaaaggtggaaaaccagcgtgattttggttccgcgggtggagcattgtcctatcaggtgggagatcgtgtccgccacatcaaatttggcgatggagaagtcatggcaattgtttccgggggcagggactatgaagtgaccgtagatttcgacaaagtcggaacaaagaagatgtttgcaagctttgcaaaattaaaaaagatatgataaattttttataaacgcaaatttttcataggaaaacagggaaagatatgctataatggatgtaattaaaaatgcaggaaggagaagtgccatcatgagtaaagtagaagatattttagcatctaccaaagtgggggatgttttggatgcagcaaagcttaataagtttttgaagagacaggaagaagaggagaagaaaccttccaaattcgtgattgtattcgccgtgattggaatcgttgtcgcagttgcagcagcaatctatggaatttatcgtttctttacaccggattatctggatgattttgaggacgattttgaagatgagttcgacaatgacttcttcgaggatgaggatgatgagccggctgcagagtctaaggatgcttccgcagacaagacagaggactaatcattgtcggaagcgtgagaactttcaggcagtttgagcggtgcgcagaaaaagaaaaccgaacgaagaaagaagggactgcagttgtgtagtccctttttctgtaagaaaataagattcagaatgatgcatgaggagtaaaagaatgaaaaaagggcagattgcagaaggaaacgtaacaaccgtagaattcccgaacaaagggattgtgatgacagacgagggagaacgcgtcatcgtcaagaataccattccgggacagcgtgtttcctttgcagtaaataaggtacgaaaaggaaaagcggaaggacggcttctggaaaccgtgaagaaatcgccacgggagaccgcagatacctgccggcatttcggacagtgcggaggatgtacgtatcagagtctgccttatgaagaacagttaaagatcaaggagacacaggtacgcggcatgatggagcaggcgatcggggatgcctgtgcttatgagtttctgccaatcagacacagtccgcgtgtgcttgcttaccgtaacaaaatggaattttcatttggagatgaatacaaggacggaccgctggcacttggaatgcacaagcgcggcagtttttacgatattgtaacggtagaggactgccggatcgtggatggcgatttccgtgcgattctcatggcaacgctcgcttatttcagggagcaggaaatcttcttctatcacagactgcgtcataccgggtatctgcgccatcttcttgtgcgaaaggcagtaaagaccggagagattttagttgatctgatcactacgacgcaggattggagaaatgtacaggagcaggagccggacgagcgtgcaaagatagaggctgcattgctggaaaagcagggcagatgtccacatgccggaacggtaaacgaaaaaaaagaaaagcagcttttagccggatggaaagatgtacttctggcactttccctggaaggaaccttaaaaggagtacttcacacaaaaaatgacagcgtggcggatgtcgtaaaaaacgaaggaacggaagtacttttcggacaggattatttttatgaggagctgttgggactgcgttttcagatttcaccgttttcttttttccagacaaactctctcggagcagaagtgctttattccacggcccgcgaatttatcctcggggataatccggacatgctggcagacaagaccgtttatgatctgtacagcggtaccggtacgatcgcacagatgctcgctccggtctgcaaaaaagttgtgggcgtggagatcatcgaggaagcggtagaggcggcaaaagagaatgcggcactcaatcatctggacaactgtgaatttttggcgggtgacgtcttaaaggtgctcgatacgattgaggaacggccggattatattgtgcttgatccgccaagggatggtattcatccgaaggcgctggaaaagattatcaattatggtgtggatcatatgatttatatttcgtgtaagccgacgagtctggcgcgggatctggaggtgctgctggcgcgggggtatgtcgtggataaggtgcagtgtgtggatatgtttccgaatacggtacatgtggaaacggttgtcaaattatccctcaaaaaagatgcacctaagattgaggttacaatggagcctgatgaagagagtaattatacaccacaagaaaaggctacttatcagaagattaaggattatgtgaaggacaagtatggtgtgaatgtgcatacttcttatattgcacaggtgaagcggatgtgtggtctggatatgggagagaattataataagtccaagaaggaaaatccagaagtgaagcagtgtccgcaggaaaaggtggagtatattaaggatgcattgaagcattttggattaattaataagaacatataataaggtaaaagtataaagaatttggaggtaaatcatattataaaagtgatagaaaatgaaaattttgcatcatgggcgataatatctgtttttgtactattattcattgttgctactatatttattattacgagaattatactttataagtctagagtaatagatgaaaacactacaatggcagaattagatacaatggcaaaagcatatgtgaatcgaccatatgaaatagctcaaacagtttttgaaataattataagtaatacgtgtattatagtaatgatgtatgtttattattgtatagaaaaatatatgctgtttttacaaaattatttaggtattattatgattgcacttattgtcttggctatagtattaaataattttttggattacatattgaaacaagatatgcttaagatagaaaatcaagcaaatattaggctgataagcagttgtagtgttattatgttatttttatttcttaagatatactttaaaactatggaatatgatgagtttttgttatgctatattgttttagttttaggaagatttattttttttgattctaccattaatgagtttaagaaaagtctaggagatttgaaagagtatgttatccctttgattattgcatttattcttacaggaattatttcgtggataggattatatttaaaggttataacgactgacaatctttttataagcctcataatgtgtcatattgcgatgttattttttatttatataatgaaaaaaataatacacgatataggtggatttgtttagatgtatacacttagaaaatacattatcgttatatgtgtgatgatacattaaaattcgtagaggcatattgtatagctatgtaaattactcaaaatagaaggttgaaatataccttctttttttatatccattttaaggaggtggtgccgaaaagtgtacatttagggactgaataataagggcatagaatcagtgccaaaaagtagagactttccattatgggaggtctcattttttatgtaagcattttaagactaggaaaggagcaaataatcatgaagagatatggttatcacagaacaagtacaagagaacagcatttagacagaggtatcaaggagattacagcctattgtgagcagaacaatctggaactggaaaagatatttactgaccagcagaccggaaagaattttaatcgtccaagatatcaggtattgaaagaggatgtattaagagcgggtgacgagctaattattactgaggtagacaggcttggcagaaataagcaggagacattaaaggaattgcagtattacagggataatggtattcgtgtagaaatactagagcttcctactacgcttatggatttatcaaagctggataatgctatggctcgtatgctgatggaaaccatcaataatatgttgatagagctatatgcagctatggcacaggcggagattgagaagaaagagaaacgacagcgtgaaggtatagattctaaaaaggctcgtggagaatgggatgattacggcagaccagcggtgatgtcgattgatgaattttcagagcattatcagaatgtggtgtcaggagaaatacgtccatttgaactgatgaaacagcttggtatgaataagagtacatattacagatatgtcaaaagaataaaggaataggcagtttataagacttttgcaattcttagaagctgttctttctttgaagagtcaagtttatcaacagtgctatttccatttgtttttcatgaagttttctctggacttcttcctgctcaaagatttcctgctggcatttacagcgaatggaaggaataagaacctttccctgtaattcatgcctgcatttccttggcgtattgcatttggaacagtagatcaagtggtctgtttcgttaaaatattcatcaggctgaagctctctgcttggtgttataacggttgctttttctgtaaatcttgtcatagtgtttcgtattcctcactttcgtaatttctttgccgggaagcaggatgatcctgtcttgcccaactgatgatggtagctgcatggttctgatattgcgttccggtagaagccatataaccggataagcgttcaatataatcctgccagtcagggattgtctgccggatatctttcagctcttcctctgatagaaaaacattttgaaattttccatagggtgagagtggctccttactccctcttattgctaaattgttcttttttatctctttcttattaccagacagttttctgtctgtatcatggaaagaattctgtctgtcaataggacagttttctgtctgtcttagggaaagaaatctgtctgtatagtggatggtttcttttggaagttttacataaatccgattgggttgtccgggtccctgccgttttcggaagataagttcttgtttttccagtactgccagagcagttttaaccgtcatctggcttttgtggagaacttctgccagcgcttcaatcgtaaagtaaatgaacacatgaccatctgtatctgaccagccctcatttttctgggaaagccttgcccggtcgagcaggataatataaagcattttggcggtttcgtttatttccatgtccagaaggaaacggggaaacatcatataagatggcaggttggtgtctgctgtcagaaagtcagtcatgtgttcacctccaatcaaaaaggtttattctccaagaaaatcccagtctatatcactatctggctgtgaattttcaggtgttggaaagggcgccctgatttggggctccctttgcaccatgcctgcagtcagtccggaaagaaaaagtggcaatgactgtttcaggctgtattccactgcatctacaatttgtttcacaaaaagttcttcccgctctcttgtttccagataaggatcagcctgtgtgcggtagtagcggtcaaaataatctaccagcgcaagagagattacctgactgtaagatttaaaatcctgcctgtccatcgtctgtaaatattcccaggctctccgttgctgttctttgtccagattaaaacgcaggtttgtgttgcggatattgttctgcatgatttatcccctccttttcaggctcatataagccagagattcataacctttggcggtggcacagatgtcatcaatgatagtgactcgtgatttgtcataagttccgaagttacggatcagacatccaccgccgccaactacatacaggcgcattaggtcaggattgtattcatatttgcggagtgtggaaaaaagttctgccacatactgtctggcaatagaactgatacaatccagatatggtgctgaaatgtcagctgttccaaaccgcagaatctgttctactgtggattcttcaattttcactccgaatttgtccagaacagcgttctttgcggcaatcatgcactggtttacaccaagtttttctgtccagcatcggctctcctgcgctttcttattgttgacatacagaatgtttatggttccgtttccgatatctgcaaggagattggttcccttgaaatttcctagttggtttacgatagccggatacccctgtgggtaaaggctgcatcccacaaagcggagatgatactctttgccgttaaaaaggtaatggacttctggattctggagcagataggaacgaaaagcttctctttgatttctgatccatgtgagaggaagtccggcagccagatgaacatctgcttcacggatggaaaagacattcagttcccttgcaatagccattagtgtcagaagataatattcttcgtccatagctttatccgggataaattctttgtgtccttcgccgatccggtagtaaatgccgttgtattccagaatattcccggtgaagatcggttcagtttcataggctttgatgccggttggggtgacggtgtttgctgttttcatattgccgtagccatgatctacagcaatgatttttgtgtttctgagttctcgcataaaaaatacctccgttttcgtattgattgattcagcaggtcgtaccggtgtggtactgctttgctgtgggataagcatacgaaaatcggagaaaaaaggcattgagaggaaattgagttggaattgagaaaaaataaactttttattgataaataagtttagatactaactcttttgttgttttggttgttaattatattaaaagtagaaatattttgataatgaaaatgtgggagagaaaatgaacaaaagaagatacagcaatcgcagaagaaagaatattttacgtgtattcattcttttaatgactatcataataaccgttgtaatgtggagaacaataaaaatcgatgtgcaggttggagaattaacattaccgaaaattttgcagtcagaaaagtcctttgcagacacttcgggtgaatggaatcttattttggtcgatcgaaatcattatattccagataattatcaagtagaattgacagaattatcgaatggtaaaaaagtggattcacggatttatccagaattacaacaaatgtttaatgatgcaagagctgaggggctggcactgtttgttagagaaggatatcgaacaacagaagaacaacaaaaaattatggacgagaaaatcaatgaatatgaaaaacaaggatattctgcgaaagaagcaaaaaaaagagccgagaaatatgttgcaattcccgatacaagcgaacaccaattaggactgagtgttgatattaatgcggataccgacaaatgttcttctgaaaaagtatatcaatggttagacgaaaatgcatataaatatgggtttgtaaaacgttatccggaagataaaacggatataacaggaattagtaatgaaccatggcattaccgttatgttggaacgactgtcgctaaaataatgaaagaagaaaatttatgtttggaagaatatttagaaaaatataaataaaaacaaaagaaaatcctaactttttttatagtaggattgttatattatttagaaaacagagggaggcaaatttgcgaatggaatacaaaactgattttttgttagtacatctagcaagagcaggagatgaagatgcttgtgaaaaactggtcaaaaaatattactcaagtatatatcaatattgtttgctacatatcaatgatccctatgaggcagaggatttgacacaagaagtatttacacgtttcttttccaatttatatagatataaagaatatggaaaagttaagaattatctttatacaattgccggaaataccgttaaaaattattacaaaaagaaaaaagatattccatcagaggaactgctaaaatcagaggactgtagtaaaaatcatgtagaagagctaggagtccgattaactattgaacaggcagtgagaaagttaccggaagaaattagagaaacggcagttttatatttttttcaagaattgaaacaaagagaaattgcagaattacttcatataaaactttcgcttgtaaaatatcgaattggaagagcaaaagaacttttgatgaaagagttggaggtgaaaaactatgatgaaatataagcaacaaataaaggaatataaagaggagattgaaaaaaaatatgtaaggattgaagcagaaaacagaacagtaaaagcatgtcagaatattttgtcagagtcaattttatcgaaacaatcgcatagaacatcttattttgaatttttgtatgagcagacaaaattcataaaaaaaagatggtggattttacaaggttgtattcttatgtgtctatggatatggttgagtaattatacgtcagacataaaagatatgatgaggattatgggaatatctgccacaatatttgtggttctgattgtcccggaaatttggaaaaacagaagaaatggtgcgattgaaattgagcaggcgtcttattacacactgcgtcagatttgtacagcaagaatgttaatgtttggagtagtggatctggtgattgttatggtgtttttggcaattacatatcaaacaacaatactctcgttaagtgatttggtggttaattttttgcttccagtaaatgtttcatgttgtatatgttttcgtgtattgtacagcagatgggaaaaatcagaatatatagcagtgctttcctgtctggtatgggttggtttatggatgatgattgttgcaaatgatgttatttatcagaaaattgtaactccggtatgggtggctatgctgatattgacttttgtatattttgttttttgtgttcagaagtcattagtatttgatgaaaaaattttggaggattacacgtatgaaattagaatttaaaaatgtaacaaaacaatacggagaagtaaatgctgttaataaagtgaattgtgttatggaaaaaggaatttatggactgcttggagtaaatggagcaggaaagaccacattaatgcgtatgctttgtacgattgttcaaccatcagaaggacaaatattatggaatggtaaagatatatggaaactaggaggtgaataccgagacgttctgggatatttaccacaggattttggatattatccagatttgaccgtatatgattatatgatgtacatttcttctataaaagggttaaaaatgccgtttgccagaaaaaaagtgaagcaattattaaatcaagtaggaatggaaaaatttagtaaaagaaaaatgaagaatttgtctggaggaatggttagacgtgtaggaatagcacaggcgatgttaaacgatccgcaaattcttgtcctggacgaacctaccgctggattagacccgaatgaaagaatacgttttcgtaatttaattagtgaattgtcggaagaacgtttggtgctcttgtctacacatattgtatcggatattgagtacattgcgaataacattatgttaatgaaagatggagaacttttttatgcaggtactgcggaagatttagtatcttctatgaaagaaaaggtatggcaatgtaatgtttcgagaagtatgatagacaaatatatgaatgaatatttggttggaaatataaaaacaacaaaaaccggagcagagcttagaattatttcaatagaaaagccaacagaagatgctgtggctgtagaaaaaaatctggaagatgcatttctattttattttggagaaaaatcggaggaaaaacaagatgcttaaattagaattaaaacgaattttttcaaagaaaattaatgtatttgcaatcggattggcattgatacttgctgtcatttttagcggatttgcagttacaagtaatcgctatgtggatgagaatggaaatgctagtactggaattatggcaacaagaaaacttacagataacagacgagcatggaaaggtacattgacagaagatgaacttggaaaggttatagaacaaaataaaaatgcgatgacacaatcctcagaagaaaatgcgatttatggaacgacattacaaccgatagatgatattaggggttttataatatcggtattaacaccggatgcagaatatgatgaaagtgttctaaatcaaattacagaagaaaatatacaagagttctatgacacttatcataaaaatatggaaaagatggcagaagaatatggaaagacttctgttcagaaaaaatacttggaaaagaaatataatgaaataaaattaccagtagaatacgaatcttatagttcgtgggatactatgattatgtatgtagaaacgtattccattattctggcaatcatagttggttttatttgtgctggaatatttgcagatgattttcagacaaaagcagatgcagtatttttctctacaaagtatggacgtacaaaagctgttaaaacaaaaatactggcaggaatagctacgacagttatgatttattgtatgggaattatattacttagtgtgatttgttttggaattatgggaaccagtggtatgaatacaccctatcaaatgtatcaggcatatagtatttacattatgtcatatggacaatactatttgttgacagttgtatgtggatttatagccagtatgctggcggcttcagtgtctatgttagtagcggctaaaatgcatacaattagtgtcgctgtttgcattccgttctttttatattgcttattgccatttataggacgggcactttctgggtatacaacgcttttcaatttggtaccaacaattttgacaaatgtacaggcaagtgtaaaagtcccacttatttatcagattgggaattgtgtatttcgacaaattccgcttgtaatggtaatgtatacagtgatggcaatagccttactgctttttatttataagagttttcgcagatacggagataagtaaaaattgtattcatactcatgaaaaacaaagtattttctggaaaatcaaagcataatttaaagaccggatagattttttccaaggcagctgagccatgaaattcaagtttgtcattttcccaaagttgcctaagttcagccatgtattttccacgaaacgtttttgagattatcttaatcggaaggaaaaaatctttcccgttgtctttccaatgatttttcacatccagccctccaccaagaacaatcgcatggatatgaggatgaaaattcatggtacttccccatgtatgaaggatacagatatagccgatatcagtcccaagatatttacaatcagcagcaagttcactgagagtatctgaagccgcatgataaagagcagtgtataagactttctggttgctgtagataatgggattaagttcttccggaactgtaaaaaccacatggaaataaggagcatctaagatatcctcacgccgtgcatctacccatttttcttttggaaactcctgacacataggacagcacctgtcacggcaggagttatagtggactgatatgcagccgcagtcctcgcatacgcttacattcacaccaaaggcgccggttttgcaattcatgatgtggtaagcggcttttctctgagcgggagaaatactatgtgtggattcaaaagatgaataaaaacgatgaaaaacatcctgaatcgtacaatccttactcatgattcaccaccttccgggttgtcgaacgggctgcggattcccagaattgtcttgttgctcacatgaaggtaaacatctgtagagcgaggatcaacatgtcccagaagtgactggatatattttatatctgtgccactttcgaataagtggctggcaaaactatgacggcacgcatgagaggaaacatgacggttaatgccggcgagtttagcacttttcttaaagaactggttaacactggctatatcaagatatccaccggaccaggaacttgggaaaaggatatctttgggacgaccacatttgtaccaatactctgtgagaaggtctaaattcttttgagacagaattgtatacctgtcaattcttcctttggtttcacgaacatgaattgtcatgttggtacgtgaaatgtcatcataatgaagatgaacaacctccgatacacgtaatccggaagaatacatagttgcaataatcgctttatgtttcagattcggagtggcgtcaatgattgcatttatttcatcgcgggacagaacggcaggaagattgcgctctcttttcatagctggaacagtgtcatcatcccagacagtcttcagcacctttttatataagaactttattgcagaccgatagtgattgtgagtttcaggagaccttccttccagacgtttggcagtaagaaaactttccgcatcttcaagtgtaagatcagaaacattttttccgatccaacgaaggaagtaactgacatcagagcaatacagttgaatagttctttcacgcaggttacgtttttccgcttcattgcggatagattcaaaaatatcgttatacataataaaacctccaaaataagtagtgttaataattacatctacctattcggaggtgcattagcgtcataattccgattgcggaagagactggaaaatgttattcttatcataggcagtggagctttcttagttcagttgtttcgtgtggtaacttaacaataacggattatgaaaagtaattcctctgctttttaataaaaataaaactgcgctacagccttggcaggccatcgcgcagcgattttgttcaatcggtatttgaggagggctatgatggaatgatttactgtgcaattattctttcaattttattcctgcttagtgggattatgagtagttcagtgttattaattattgcatcagtattatttgcaccaagtcatattgtaacttcatatagaaatgcaaaatgagatttgcaacttggtatttgtaagttaaaaatagatgaaaatgttttattgtgcaaaggagtgtgtaatatgagcgaaaattttaatagtcatattgcctgtgaaggtacggataatgatattaattgggtttgcaaagtctgtaaagatttgccgaattatgcgggaatgtacttgtatcaacgagaaagagaaaaaaatcagttgaaaaacgtaaaggatcgatgtgctgatttaatactgatgaaatattattatgccttgctgcacctgttggacaagatacatgagcttcatgaatgtcctaatccggaaaatgatgtaccaaaatacgcagaccggaaatgctcaacaccagaatgttttgtttattatcgatatatatataatacttatgcgagcattttgatgacagaaaagggacttaatcagattaatctaagatgtgatatttgttctgttttaccttatactatttttagtgacttagaaatgattgctaaaaatatgcatagtgatgatatggagaaaacacaaaaattagagatagaagcagtaatcgcagattattatttagaagcggttggtttttgtgaacagtgggatgagtgtccgagcggagtggactggttggaattgataaaaagtgttcagttgttaaggaaatatctggaaaaaaaagatcgtaaggaacttcaaattagtctgaacgaatggaacagagtacggtctatcgacaacattctgaacactgaaataaaaacaacttgtagagactttcagacgaagaacattccgttatgtgtattggaaaagaaaacgcttgtgtatatggattttggcgtttatcaactatatgagagtaatgaagttttccacacacaactgtataattatgccgaaatggatgaaattcaatttgtgtatagtcctactcatatggaggaagtatgtaggatggacaattctatatttgagggcaaacggcgagataatatttcaaaaatttgtagcaactgcgaagtccttccggttcgggacggatgtttcaaaattctcacagaacctgtagaagtgtgctttgaccgtgcgaaaaaacttcaggttttgaatcagtatgctgaagagtcagaatgcgctacatttgagactctagaggaaaaaacgtgtggattactcagatgggacgaaaaagaggtggaaacacacagaaaggaaatttctttgttaacatctacacggttatttgatccgaagaatgagatgattgataacgaaagcattaatagggtattttacgagatttgtggttctcgttttccagttgaggactttaaggattattgtaaaaaggaaagaaccttttccgagattagagaagcggttcggcttctgtttatactaatgaatgcattaggctatcacagaaataaaattgagaagcgcacaaagtttacatataaagctttttatcctacttatgatcgtgagttttacagaaccattagaagtggtttttatgatgttgatcatatctgttatgcgtcaaaatgtaactattttgttacctgtgattatgcattgtcatcgcaggcgatggaaatttatcgttatcttggatgcaaaaccaatgtcatctattgtgaaaagaaagcacctgatccttccttacctttggcagtgttatgtaagaaaacagctactccataaaacttttgtgatactatatcggttcgttcattgtaatcatatgtggaaagtattgctttcttacttcaaaaaattcgttctaagagagaaataaattccagttgtaaaaacgaatgcaattcatatttaatagattataaggaattccgtatggaaaaacatgctaagaagaacattatttgatgagaaaaggtgaggtatatggagagacagcaagagtatgaattaagaaagaaaattgcagatgctatacaaaatgatgtcgacagagtattttctgaaaaattacagttatttaatcatgatttctattatgagattctttttccacttatcgtgttagaaatgaactataaaatgaaatctgaagaatctttagctgcgggattgggtgattctaatgaatatctcattttagtaaatcctcttcgagaagctatatattggtacatacatagggtgctcatatccgataggaagattttgttttcaaagaaaagatatgttcctagtttaggtgaagaatattcatttgttgagtatgtattacaattgcacgacgaatttaagcggggagagcaaataagagaaatacgtgattgcgcttcaaaggtaatgataaaacctgaagatgataatacatatggtttctattttcctgttatttcagaaaaatatcataaagaattattatattattatggtttagatgatactttgaattttgaggtagaaaaagaaatatttgttgaatgtgagaaatacttgcatgataaaatcaatgtgaaagagttaataaaacatcctcagaagatttatattttttataatatactaaatagaatggcaaatgttattgatactaaatatttcgagttgtgtaagaaacgtgtaatgtcagacttaaataagatatcgtcgtcttcacttagaagcttagatgataatacgaataaagtgattattgggagcaaagatgagttggccacatttttggcattgctttattatctgagtaggctttgtatgcagaagtatatgttggcttcgtcgactatggtgggtgaattggaatatgtatgtcagtatgatctcgtcaaaatattagcattagggaggcaaataggaatctcgagagattctgtaatgagttatatagattatttttcgatggatgttaacgtgacaagtggaaattttactgaatttcccctgttaaaatttaagaataaaattatctggataccaagctccatagtattgaatgattttcaattctcgatagtaaatggacattactacaaaggaatacgtttcgagaataaggatgagacggtttctcagtcaataattgattatattgttaatcatgtgaataaatattcgaatattctttataatacaaattatgtttattcagtacctaatgagacatttaagggaaagccccttaatagtgatattgatgttgcaatatatgataaaataggcaaaaagttgctaattattgaatgtaaatggaaggaaaatgtatatcaaaaccgtgagaattatataagaattgaagatgccttaaaaaaaatatatgataatcaattggaaaaacatcaaacctatcttgaaagagatattaatagactaaatgagctatttgataatcagattgactttacaagggaaggagacgttgataccttatatctttttgttgataaaaggatacagtatcatgataatggaacaaatcggcatgccattccaatttttatgcttgcttatttatttgaaaataattcatctaagaggcaattaatattaagtgatgtgttctcggaaatacgggaaatgaaaagtagggtgagatatgaaagaattaaactaaaagaaccagtacatcttggggaaataacagttatataaagttgatgaaccatgtatataagttattttgattcggtagatttcagcttgcagtaataatgtaatcatagtaaacatactagttcaattcttgggggatgcttcatactggtccatggtactgaattagtaatatatagtaacacttaatcaaagaagaaaacgctgacaaggaggtaacatgggagagattgttggactatgtattggaagttatgaatttttatcacgcaaaaatacttttggtgatttattatcaatttttagtcaagatgatttgacgatagaagaagtatttgacaaagaactagatgaaagtattactagacgatattttactacgactgttaataatgtaaaaatgtgtttagatgtaatgggacatacaactctaaaggcaaaaagtttatttgaataccataagaagaattatttagactacttagaagatgattttgatgatgaagtcgatagtgacaatattgaaagagagtatacctttgaaaattgggcccgagcagtaaaaaagtattcttcaatattagcgtccgatatttatgagaatggtgattatatatcattagagaaatgcaggggagagaacaattctctgtgcgagaaaatagtattagactcattaccacattgtaaggatgatacatattttggcattgatttctattatttagatgaagaaataggatcaccgtgggatgtatttcgtattattttagaagcatttaaatcggaagacataattactcttgattatacaaatttatttgagggtggatggtgtgatgaggttccagaggaaaaagagtatttagtatctaagacagttatacttacagaaggtagtacagatgcaagagttatatctgaagcaatgaaattgttgtatcctcacatggtaaagttttattcttttattgatttttcaacttatgttgtgcagggaagtacaaattacttaacgcattatttaaaagcatttattgctgctggaatcaggaataaaattattgcattatatgataatgattcagctggtttaagtgaaataaaagttttaaaaaatattccaattccatcaaatgtaagaattatgcacttgccagatttagaaatgtgtctccattatccaactattggaccgggaggaagttcaatagacaatattaatggtcgtgcttgctcaatagaaatgtttcttggtaaggatattctgaaaaaaagtggagaatacgagcctgttcgttggaaatcctatattgataaagtagatgcatatcaaggtgaaatagtttctaaatcagaagtgttgaaacagtttaaattgaaggttaaaagaagtcaggatcaacttgttttagatgaatgggaagagtgcgatttgctacttagggaaatttttgctgcttttgaaaagtagtattatagtagaaatgaagtgatagactattgtttgtcagtttgaaataaaataataaaaataaaacagcgtcagggtagttataagtcgagagatttatagctgccctttttttattgcttttggacacgatgtccagaagcggaaaggagaattatgaggtatttattacatcggctgtatgttccaccttagcggagcatacgcacatggaaatgcggatcggaggtacttatgtaagaggaagtaacgcagaaaacaatcgctcttgtaattaagaccgctaaattggatgccaacgtcttgaaggctgcaatgcggatgtatctgaaccaccgcaggcagaaagcacagaaaacgcatggtaaaacttctgtgaaaaagctggttggcgaaggcgtgggagtttcgtctatcgaagtgacggacggcaatatcaaatcctttgagcgggtagctcgtaaatataatgttgattttgccgtcaagaaagacaagacaacggacccgccgaaatatgtggtatttttcaagggcagggatgccgatgcagtagcacaggcattcaaggaatttgtttatggtaatgagaaacgaaagggcaggacttccgtaagggagaaactgaaacgctttagggatgcagtatcacagaataagaacagagaacggagccgggaaaagaataaggacagggggcagagcctttgagtaacatcattgaaggcataaccaaagacctgacggaaatcccgaaaaatctgaaagcaaaagcaggaggtatggataccaagaagctagtgcttttgaatctgccctatatctttgctgggtatttctgtgacaaggttgcatggttgtggagagtatcggaggggacaaatgcttccgataagatgatggcagtcatgaaccgccttgataagctgtttgccaatcccttgcccagcttccacccaagggatttactgattggtgtggcaggcggcatagcactccgacttgtggtgtattacaaagccaagaatgtcaagaagttccgacagggtgtagaatacggttccgcaaggtggggaaatgccaaggacatagagccatatatggattctgtgtttgaaaataatttcttgaatccgatccagagacgttttctctggaagcagaaattcatcattacatagaaatactggaaccagtcctcagaggtgacggacaggagatgtggcaggcattggacagaattatttcagcgaaaaattccatggaagggattatggaaaaagaaatgtatattcgaggatttctggattatgaaaggctggtgtgtgagaaagacaatcatatctgaaaaatgaaaatgtgacagcataaacaaataagaccttctgtgaaagcaatcagccacaggaggtttttgctgtcccacctgcataaaaaaacatctctgttttcgcattgattgattcagcaggtcgtaccggtgtggtactgctctgctgtgagataagcatacgaagatcgaaggaaaaaggcgttgaggggaaattgagcaggaattgagaaaaaagatatattgtgcttacgttcttcatgtactcttgttgtgatttcattgttttttatcgtataatatggatactggaggtggtttggatgaaatacaagattttagttgtcgatgatgataaagaattggtgaaaatgctttgtagctattttaatatgaaacaatatgaaaccattacggctacagatggaatggaagcattaaataaaataaaaatgaaaccggatattattttattggatatcaacatgccacgcatggatgggattgaagtatgtcgtctgatacgcagtaaagtgttatgtccaattttatttctgacagcaagagttgacgaagatgataaaattaatgggttgctttcaggtggggatgattatattacgaaaccatttagtcttcgggagttggaagcaaggattgtcacaaacataaggagagaagaaaggcatcaacaaaaaacggaataccgtttcatggatgaaatgctgattgattattctgaaaaaatagtagctatagctggacacaagatggagttcacaaaaattgaatatcagattattgaattcttatccatgcatccagggcaggtgtttgataaagaacgtatatatgcacaagtctgtggatatgatgcggaaggggacagtagaacgataacggaattagtacggcgtataaggaaaaaaatagcggattattcagaaaaagaatacatagaaactgtatgggggattggataccgatggaaaaaataagaaacttgtcactgaaaaaaacaattctgctttatcttgtgatcagcttaacggcagcatttctgttatctggatttacagttcattttgcaagaaatatgcagaataaaatatgggaaaaatatattaattatgcagattacacggacgtgtttcagcaatatggaaagaaatacgagattgagatatcaagacctaatcaatcgcagatgaatcgtttggactatcatctttcggaaatgtgtgactttatggtaacatattcggtactgattttttcgattgttgggagtgttgctgcggtattctttttttataaaaataagttaaagacacctctacaggaactaaaagatgcctcacaaatgattgcagataatgaactggattttcatgtgtcctatgaaaataaagatgagatgggaactttgtgtaaagaatttgaaatgatgcgaagtgatttagcagataacaacagaaagatgtggcgaatgattgatgacgagaaggctttgcggaatgcaattgcacatgatatacgttctccactttccatattgcgtgggtatcaggaaatgctcttagagtttgtttctgctgagagtataaaaacagaggatgttattgatatcttacaaacaggcatgtatcagattgaccgtatagagcatttcacggaaaacatgagaaaaatgtcccatttagaacagagggaactgcaatgctcagagatagaattatcggaactggtaaaaaagattgaggcagaagctgccatgctgtccaagaaggaaagtaaattatgtaaggtagaaagagtgcaggaacaaaacattgtgaaagtggatgaggaacttgtcatggaagtgacagacaacttactggaaaatgcgattcgatatgcacaaaaaagtattgctttgcagataaagaaaaaggatggttttcttataatttctgttgaagatgatggaataggatttgtggatactgaggaaaaagtaacagaaccattttatcataagaatccacaagatgatttaaagcattttggccttggtatgtatatttctcgtattttctgtgaaaagcatggaggaaatttgaaaatatataatgccagacaaggcggtgctcatgtagaagctcttttcaaagctgaataaaaatactttataaggctgaaatcacaaataaagtggttttagtcttttttgttgtgaatttattgagaattgatttgtatgatgttgttaaagaaataaagaaaggaagagatacaatgaaaacaatcataaaaagaagtatacttgattatttaaagaaccctgttttgtggattggcttgattattatagttgccagtatgtatcaatgtctgtcatcgtatttgcaaattcattatatcaaacagaatgaacagatcacacaaaatgacgtagcattggaagatgctgatgtcatggatgggtacattcccacatctgatgataaagaaagaagaagggagtgggaagatacgatcaaagagacgttaatggacacctccaaaaatggttttggatttagcaggcaggaagcagatcatgtaatgaaagaaattcagaatatggatgtaaagactgcttctgagtttttggaatcccaatatggctattataatgcaatatatgcttatgaggaccttgaaattcataaggggacagcagaagaaatcaatcattatatcgagcggaaattatccgaacattctttttcctggtactttgccaaaaaatttacggattttgcaggattgcatatggccttttttgcaacagtcttgctatcatttttatttattcaggatacacgaaaaagtacctatgaattattacatacaaagcctgttacggcaatccaatatatatgtgggaaagtaataagcggattcattagtatgctgggagtattagtgattttgaatgttatattctttatgctgtgtttgaaaacgtctttagaatcgggctttccagtaacaccaattgatttttgcgtgaattctctgatctatattgttccgaatcttttgatgatatgttgtgtctatacaattacagcattaatatttaaaaatccgcttccggcagcaccaatcttgtttttacacattatatattcaaatatgctgaccatgaagaatgatatttattatatgagaccgttctctattatggtgcgattccctggcagattttttgaaacacatgcagctaaaatgtcaaacataaatcagattattcttgtaatttcatcagttatattagtatgtatttctgttacaatctggaaaaggaggagggttcattgaaaacggaactaaaaaactgcctgtcgttatataagattttttattcatgtgcatttatactgatattgtgtgctattcatccgattatatactatgaagaaatcggttcagcgattcagtctccaatagcatttttaacaattattttttgtagtgacacatatttgaaggaagtaaaaagtaagcgtgccgatgtatttcatttgtatgatcaaaaaaagcagttaaaagtaatatcacagagagtgtgcgttcaaatattatatttattaatactttcctgtgttggatatgttttgtttttctggcaaaaaccgggcagtgtaaacgaaggcgtttcgggcactcagatattccttttattttccattgcaatgttcggaaccatctggctttggagtatatgctctgtgattttgtgtacattgcttcgaaatatgtgggcaggtattggatgtttatttggaattgtcattggacttatatcaaaagcgggaagttcatttttcggaaatctgggattgttttctttcagcttttgtgaacctactcaattaatgtccgagagttggatttatggaacgcttgtgtcttttatagcggggctgtttttatttgcagtattaccaatgactttaaagaaaagaggatagattatgagtattagaataaatgatttaacagttagatttaaaaatggtgtagttgcggtaaataaggcatctcttgaaatacctaagggaatttacggacttttgggtgagaatggtgccggaaaaaccactttgatgagggttcttacaactgttttaaaacaaacggaaggaatggtttcccttgatggaattctgtataacgagggaaattatgagaaaatacagaaaaagattggttatcttccacaggaaatcgacttatatccgaatcttacggtgaaagaatgtcttgtatatatggggggactgtcaggagtagccagaaatgacctcgaacaaagaattacctattatctggaaaagacttctcttacagagcatcagaataaaaaaatgcggcaattatctggtggtatgaagagacgtgtcggactcatacaggcacttcttaataatccggattttttgattattgatgaacctaccaccgggttagatccggaagaaagaatcaggatccgcaatcttttggttgatttttcaaaggatagaactgtgctgttttccactcatgtagtagaagatttagcagcaacctgtacacagcttgccattatgaaaaagggaagttttttatattctggaagcgtgagtgggttgctggaaaatgcaaagggctgtgtttggaattgtacggtacaaaatgcagaagaagcccgtttgttagaagccaattattctatatcatctaagcagtatgtagaaaatggaattcatatgaaagtattaagcaaaggaaagccaaatgagaattgtgtcctggataaggatatcactttggaagatgcatatatttatttgacgaatagttgaatataacggcgggcaagttgcccgccgtaaattatgcttattttgttaaaagaccggatagatttttttcaatgcaaaatccaatctgtggatataactcctgaatttcctgatattttgcttcaatcatttctggttcatcagcccagatcttttcatatattttgaaagctcttttaaaatgtgttttggcttgcggaagattggcagtcatcagataaatggttccaagggtttcctgtactttggcataatccagacagtgatcggaatggtattccttgatgatgccggataatttttgcaattcggagattcctctttcgggttcctgctgttctgtcaggaacattgcataattggcaatctgaggtatagccatattacagtcagacatcagtggaagaagattctggtggatagtatgagctaatttttcctgattggatggcttggaatagtaagcggatattttaggactgattttagcctgaccagtcatccagcgacaaaccagaccgttatccattgaaaaatcctgatttgccggatcatccataaaatcttcaaataattcgtataaaaaatcaggctgactcatttgattattttcgctgatatgattttttaagcaagtgctaatagaagaaaaatcgcatcaattcaatagaaattcccctttcgtagttaagattgagtatatccatcatatacacgaacgtatattcgattcaaggaaatgcggatagttttaaattgattgtgtcaatttacaatcaaattctattcaatgtggttttccggcaggttctgtaaaataagctcagatcaaaacaataacgggaggagcttatgcaacagaatattgaatttgagaggtgcattgattttctggtacggatgattgataagtacggcgctgaagtcctccgggagttggaggaagaaaaacagaataaggaagaaaaaacagcatagaatacttctgagcgggtatggctaagaatgttttggcatattgacaggacatttaaaatgacgtatactaagctcagtgatcgttctgtagaaacttgagaagcctacaggcgggggagagcctgcgggtctctccctcttttgttttaaggagaaatgatatgcagacaccgaaaaaattctcttcttttagtgaccaggttgcctggatcagtgacgaaaagggaataaaaataaacgacagagaatatgcagaagagatgttacgccaaataggatattttcctcttatgggaggatataaacatctttttagaatatcaaatacaaagaaatataaagcaggaacaagttttgaagaaatagtcagtctgtataagtttgatgcagagcttagagagttgttctttaaatatttactgcaggttgagcgacagatgcgttctttgatgtcatactattttactgaaatgtatggagcagagcagaagcagtacctggatgctaataattataataatacaaaaagaaatcatgcaacaatcgtaaagttgatagcgaccttgaaacgggcaacaacgaccacagattatacatatatcaactattaccgcaagacatatggtgaaattccattatgggttttggcaaatgtacttacgtttggaaacttatcaaaaatgttccgagtgtttccgcagtccttaaaatcaaaagtatcaaaaaattttgaacctttgaatcagcatcagatggaacagtttctatctgttcttactaagtataggaatgtatgtgcccatggggaacgactgtttacatacagaacagtagatgctattgcggatacactgcttcataaaaaactttcattaccacagagcggtaatcagtacgaaaaaggaaaacaagatttgtttgctgtggtgattgcttttagatatctattacctggaaaagattttttggaatttaaaagaaagctcataaaagagattgaccgagtaaacagagaagtagagcatataagtgaagttgaattattgaataaaatgggtttctcggaaaactggaaaagtattaccaaatatcatttaaagtaaagaaatatcctctaagagatagtgaaatacctattgttttagaggattttttattgaagaattttaatatttaagagtttgttttttcctctttgacattaaagctaagatttcttgtgggtttgtcaactgacgtccgggaagtgtctgctttggtgtgcggtcacggtcagcttcatcaatcgctgcgataaaatgtttcacgctattgggattggatatgacaaaattatgagtaatacttgaagtagccatacgaacacctcctcttttcgtttttttgtgtattaattatacgattgacagagaagtgcgtcaataagaaaaataagtattggaaatagttggaacaaatactaaaataaagttgggacatcgaatggaagttatgttacgagataataagaattgtaggtggaaggtttgaacatagaagcatatgatgcggattcattgagaaagatggttaggttgcttgaatatgagaacaagatattaaaagataaattgaagaaagcaggcatttcatatgaagaggtgaatccttttgaagaaaaaatagaaagtgcagaagaatatgacctggatcaagggaatcgtattgtaaatccaccgtatattacagagaaaatggcaatacgtttcttttcgatgttttggggaagagaagatgtatatgccagaagaggaaagaacgggggctattttccacaatgtgcgaatcgatggaatgaccggctttgccctaaacaacgtaaagagaaggtgttttgtgatgaatgtgaaaataccaaatggataagtctggatgtaaaaaaaaataattgctcatttgttaggcacaaaagaagatggatcagatgtaatcggtgtatatcctttattgtcaaatggtacatgcagatttattgtatttgattttgataatcacgaaaaaggagcagaggttacggactttgcaaatacggataatgagtggcataaagaagtggatgcgcttagaaaaatgtgtgtccctattttttatattagggcattccattaggagtgcctttttcaattcaatttcagaaggaggttcactatgaacaacacagcgttaggagcagtaagtaacaagaaagagaacattcgctttattagcgaagcacatgagaaattctactatgaaaaattaaaagaagtgcttgcagatgagtaagatatgcatggaataccttcgattggtgtcaatatgcacattgatggtacagaagaatgggaagatgaggaagcagatattgtcagaggaaattgcatagatgtggattttctgaattacacaccagagcttcgggatactcccacagagcaggatgcccttaaaaaactgattgcagcatatccggataaagaggttaatgacggggagacaaaggaagcaaagatacagacgattgcgacagaacttgaccagttatcctatgatattggtgctagaatataaatagtacaagccaaaatgagaaattccaaatacacataagcatggtacaatagaaacatgctgaaggaggatctcatatggcaaagcaacatgacaaacaatttaaacttgatgcaatccagtactatcaagatcataaagatctcggagtacgtggatgtgcagaaaatcttggcatcggctacagtacattaacaaagtggctgaaagacttccgagaatcaggtgatattcctgttcgtggttctggtaattatgcatctgatgagcagaaggaaattgcccgtctcagacgtgaattacgtgatgcccaagatgcacttgatgtgttaaaaaaagcaatcaacattctgggaaaatgacggaagccatttatctcgaggtgactgagaagacggaagctgccaaaaaggctggacgccgggtttccgtctccggaatgttgaaatttttaggtgtctctcgctcaggatatcttgcatggctccaccacgtaccttctgatacagaaaaacgtcgtaaagctgtaaaagcaaaaatacaggatatttatgatgattccaagcagaactacggtgctccgaaaatcactgtagaacttcgaaaaactggtgaagtcatttcggaaagaaccgttggtacatatatgcgccaaatgggaatccgtgctcagtggagcaaaccatggacgatcaccacaaaagattccgatttcagcactgaattacaaaatatcctcgatgagcagtttaatcctgatcgtccgaatgcagtctggtgttcggatattacctacatctggacaatagatggatttgtctatctgaccagtgttatggatttattttccagaaaaatcatagcctggacgctttcagaaacactggaagtatcctgcgtgattgatacgataaacaaagccaaagctcgccgaaatatcgatcaaccattaattatccattcggatcgtggcagccaatatgttgcaaaggaatataaaaaagcaaccgaaaatatgcagcgcagttattcgaagaaagcttttccgtgggataatgcatgcattgaatcctttcattctgttatcaaacgtgaatggctcaatcgctttaaaatccgtgattataagcaagcataccagttgatttttgaatatctggaagctttctacaatacgaaacgaattcatagccattgcaactatatgtcgccaaacgaattcgaacgattgtataaaagaacgaacactgaggctgagcttctggcaggttaaaatggagagaaatttctcattttaacttgtactaaatcttgacataggaccatattgacacttttgaatatagagactcggtaccggacagggaagcacaggttcaaatgattgcaaatgatataaaaagcggtaatgtgaagccattacagatttttttgcagacatctattgatgagggaattgacgaggacagcgaaagacaggcaaaaaagctgattgctaagctggcagaatataagccgcttgccaagatcgaggagctggaggagcagaattataacatgattgatgacaggctcaacaatggcgtggagaaattcaatcgtgaggaagaaaagaaagaacaggtggaaaagccgcaggctcgtacttccttaaaggagcgtctggcagccaagcagacggaagtggcacaggggaagaataaagatgcaaaagagcaggataaaactaaaaagacgaacagggaggaaatataggaatatgaataatccatttacggtagaagaaacaaatttgatgtgtgtctttgagacatcaaacagaatgaagctgatggaagaaatcagacgggtaatgctgcacataaaggacagtgatatggaggagcttgctgggcaggtgttgagaaagctagatggaatgacagataaggaatttttgaaaatttcttttgaagcagcagaagaatagcggtagtaagtgggtaggtagtcggttgcaatggctggctacctgctttttattttacaatcataaaattgattgtgaaaaatcgttggataagttataatttcggtatgcgttttgatattagaaaaacaaatattttataaaaaaataattggaaatcatagacagtttggaggtcttagtgtggaaatcgaaaaattggaaatcatagaaagtaatgagtttcaaagtttatttaataaatcaaagaaattgattgacagtgccagaagtaatatgggacaaatggcaaatgcaattacggttcttaccagttttttgctgggaagatatattgtagagcaggaacaacagggagcagaaagagctaagtatggagtaaaagtcctggattccttgtcatcatatttgatagaagaatacggaagaggtttctcaagaagcaatgttgcgggaatgcggcagttctatatggcttacaaagacagagagaatgaaattatccaatcgggaattggacaatttgaacaggcttttggaattgtccaattcccgattggataattagagacggcatataaaaaaatgccatttaagttgagctggacgcattatcagattcttatgcgtatagagctggtcacattatcgtgtcttgatgcgtataaatgatgaacaggcaagaagattttatatggaagaatgtgcaaaagcagcatggagtgttcgtcaactggaacggcagatcaatacgatgtattatcagcgtattttagcaagccaggataagatagcggttgcaaatgaaattcaaacaacagagccaaaaccagaatatgagaaaatagtgaaagatccttatgttatggaatttctgcagattcagcctgacacacatgtatatgaaggagatttggaacaggcattgattgatcatcttcaacatttccttttggaacttggaagaggattttcatttgtagcacgccagaaaaggtttacattggatggacaggacttttttattgatctggtattttacaactatattttaaaatgtttcgttctcattgacttgaaaatgggtaaactgactcatcaggatctaggacaaatgcagatgtatgtgaattactatactcgtgaaatgatgaatgaaggagacacgcagcctattgggattgtactttgtgcagataagggagattctattgtaaaatatacgcttcctgaagataatcaccagatatttgcatcgaaatatttcacctatctgccgtcagaggaagaattgaaacgtgaattaaatgtgaaagaatttcacaaaaaagaataaaaacggaaatacaaagcggaagttatagtaaaggagatttacaatggagttttggatttttatgttgattatggatttaattcttccatttacgatgattggttttggaaaatattttatgaaaaaggctccaaaggaaataaattcagtattcggatatcggacttcgatgtctatgaagaataaagatacatgggaatttgctcataaatattgcggtaaagtctggtatgtctgtggaatggttatgttgccaataacagtaatattcatgcttttagtaattggaaaaagtgaagattgtgttgggagtatgggaggaattatttgtggtgttcaacttattcctttaattgggtctattctcccaacagaaatagcattaaaaaagaattttgataagaatggaacaagacgataaagtttgcagaattaagaaaatcggaatttgtgaaggaggaatatactatgaatatagggctttggctatgtggagttttggttattccatttgtgattataggagtgttatttgcaatatttaaagaaaaagcggctaaatttgtttcgggatttaattcattaccgaaagaagaacaggcattgtatgataaagctcatatttctcgtgatataaaaaatcagtgttttacatgggctggcataatgttagtaggagcagtgttgtcttattttttaacaccatatatggctattccggcttttattatttggctcgttttacttttcaaagaggttcactttgacacgcacaaagcatttgaaaaatatttattaaaataaattccagatgataaagcagaagtatagggtttgattcatatgatttcagtaaaaaaacagagaattgctgctattatggttttaagttccatcatgctgattttacttttgtcgctaaatttccgactctggagtggatattatgcagaaggggatttggaaagtatagtcatacagcagatggaatgcttggaaaagtcaaatagtgaaaacgatataagcgaaagtatatgtttgcatttctatgagtgtatatgtttcggtggaatagaaataatggtgctctgggtatatgatggctttaaagacctcggacaaggtgagttttctttcagaccgggagttaccctttgcagtctatcggttcggatggatgattaaatacttctgataatcaaatttaaaatttattatcaggaggaacttagatgtatgtattaaatgcaaatcatatttcaaaaagttataaaactgcaggagaaactatgcggattttgcagaatgtgaatctgcaagttatgaaaggagaaatggttgctattatgggaccatccggcagtggaaagactactctgctccatgtgctgaccggggttgacacaccggacgatggagaaatcgtaataggaggagaaacgttttcacggcttacggaagaagagaaggcattttttcgcagaaagcatatgggaatgatttttcaggatttccagcttttggagagtttgacggtaaaagaaaatatattgttaccactcattcttgaacgaaaagaagcagacatccagcaagagcgtttttcaagaatagcggatgtgctcggcattgaaaaattagctgacaaaggaattacggaaatatcgggaggtcagaaacagagagttgcgattggcagggcgctgatcaatgaaccggatattatttttggagatgagccaacaggaagccttgaccgaaagaccaccggggatgtgatgcgatgtatgaaacagatgaatcaacggtctggcatcagctttctgcttgtgacacatgatgcttatacggcatccttttgtgaccgggtactttttctacaggatgggaatctggcaaaagaagtaaagaaagagaacactgccgataatttcagagaagatatatggaaaacgctgtgcggtttgggaggtggaaaagatgaccttttttgatatttcccgaaagatgctgaaagctggtttttacaaatatcgattgtactttctatgcaatttatctgcaacggcattattctgttgttttgcagttatttccacaaacaggacgtttatgaatgcgtcgattgtaaattcatcaatatccaataacatttatcttccattttttctgtctgcagtgtttctggttttttttcttcctgtttcgtgtcaggcatttctggcatcaagaaaacaggaatacggagtgatgttttctcttggcatgagccggaaggaagcgtttagaaacttactttttgaaaatgtgatcatatccgtgctggcattagcaatagcacttgcggcaggaactgtgctgtcatttttatttttttccgttatcatttatgcaatagatgttcacggagtgcaatggcagttttgcccggaagcatataagcttacagcagttctatatacagtagtggtggcagttgcctttatcctgaatgccgggagacttatgctggataaaatcggaaccctgctaaaagcacaatatcgggcagaaaaaacaggaaagatcggtacgttcttatgcagacttgcacccaactacatgaggtttcatctggtggaatggtcatttgtccgcagacacaagaaagaatgggaatgtaggtatgttttagcctctctcataatagcggtatctgttatgcttacgggggtatgtgtgactttatatccggcttttctacaggatgcaaaaagttattctccctatgacatggtgtactcagaaatctatggaatgaatcaggtttcagtacaggatgtccttcatatattggagaaaaatggtgttactgtagaacaggtcattcagcttccctatatcagagatgatgtttttaattaccttcctgtgacagaaataaaccaggattttggatgtgattatcagattcaggaaggcgagtttttgaatttgtttcagtacaatctggaagatgggtatgaacataacatacagccagtatctactgtaacgatttccggggacagaaagctgcagtctgttggaacagatgtaaagatactgtttaatcaaaatccgacctttgcagataaaacactgatcatcaacgattctgatttcgaaaaattaagtgcagatataacaggtagtgctggtatcgcaaacttgtttcagtttcagaattgggaagattcttatgcgggagtatgtgaagtaaaagaatatctgcaggaaagcaatcagttgaatgaagatgagcagacgtattatgaattgtcttcgaaagtggagaaataccaggatgcaaagaaatcaggacaatttttattatttttgatggcatttgtgatagggcttatgataatggctgagtttctgttaattcattcacgtatccaggcagagaaggaagaaaatagcagggtcgtttgtagtttgcgaatgttgggaatgatagacaaggaaatggtaaagtgcctatgctataagaattttctaagatttataccgccatcggttgtgggaacaatcctttctttcctgccatcttattatctgaatgagagttatggaatggggacgaatggaattctggcaggaatcgtatttggagtgattttgacagtcggaatattcgtagtgatacgcgggtattctgaaaaagaagaaaaactttatgaaagcggttttataatacaaggaagaggatttttcgagaggattttttgattatagataagtagaaaaagattcaaatcctgtgtataattaaaagataaagatagagacaactcggaatttcttgagggaaggtgatagtatgaattatatgataaaaggtatacaagcacttaaagaatcggttttcttaggtatcataatttatattgttatttttgtgttgctgtatcttttcaaaaaacgcagaactatctcatggaattatatgtttgagggaatattctgcatttactgcgttacgcttctcaacctaacggggattttcacactaagttatagtctgaatggtcctttcaattataatttgcttccgtttattgggagttctattgtccctatattgcttaacttcgctttgttttgtcctcttggttttttgttgccgcttgtttttcgttcctgtagaggaaattggaaaaaggtggcgattattagcggtttaatctcattcttgattgaactattacagttgtttggcggcagatatgcggaaatggaagattttctaatcaataccttgggcggattttcaggctatattgtctgtaccgccatatgcgaaagaaagacaaatcgccgaaaagcagttgtttccattgttacactatgtttgacccttgcactttgtttgattggaatttatgcagtgggggacaatgaaaagcagctaccggatggactgtctgctgtcgaaaatagcattgctgaaatcaatgtttattctgagggagaagaacggagcattagcattgattcctatcaataccgctcttttgcaagtcagatttccaattgcggcggtcatttgctggaaatccaaaaaacttctgaaggtgaaatttggaatgatacagactgctttatcgaaataatatatactgctgaccagacgataaagtttgaaaatgctgagaatttctccattgaacgtgctgacagacttttatataatgccgacaaaaatgttctatattggggtgaggcaggttatcagaactgtttggactatacaaaaatgaatgaagaaatgcaggcacataaagaagaaatattgaaaggatatgaagagttgtctacttcaattcgtgattgctttaaccagtaacaatttcagctttctgtgcggcctttatgaaggcggcctgatggagcaggcaataaggaagtgaagatgcgacaaattcctgttgtgcgcccagctaagggtgtgtagtcaagccggtggaattccggtttatccaaggtttagccaaccagataatagcgagtcttgggatgatgccggtaacggcatctgacaagcgtagacagcaagaaagcagggttgaatagtgattgagcttcgaaacgttaacttcagtcggtcgacgtcttaactggtgcggaagacaatatcatgtaatgcgatatggcgagtgttatgtggcactgcggagtcagagaaccaatcatgttttacattatgaatacacatcaactggggagaacctgccatttctcgaagaagagtatgaaattgcaactgaaaacggagtatttcaaatgaatggtaggtggtcggacaatcccatagtactgtagaaatcgggcaatgccgatggagggaaggggattgcatagtaaaggtcttactgaggacacattatccgtactcagggacggaggaaataatggaaacgaaattagtgagaatagctgagatatcggcaacatcaaaacatcctatatttacatcagtgtaccacttgataaatgaagatatgctaaagcaatgccataaggaattagatgggaacaaagcagtcggaattgacaaggtaactaaggatgagtatgggaagaaccttgatagaaatatcaaggaactggtacagaggttgaaaaacaaatcctttaagccacttccgtcactgagggtatatatacctaaaggaaatggaaagaagcgaccattagggattgcttcctatgaagataagattgtacaaatggcagtgaagaaaatactgggagctatttatgaaccgagattcctaaactgcatgtatggattcagaccgaatagggggtgtcgcgaagcaataaaagaagtataccaacggataagctatggaaaaatcagctatatcgtagatgccgatatcaaaggtttctttgaccatatcgaccatgattggatgatgaagttccttgaatggaatatacaggataagaacttattgtggctaatacgtaaataccttaaagcaggaataatggagcaaggaaaattcgagccaacagaggaaggttcggcacaaggctcagtaatgagtccgatgcttgcaaatatatacatgcatcatgtgctgacgctgtggtttaagctggtggtgcaaagggaaatgcagggagagtgttttctcgtcaactttgcggatgattttgttgcaggatttcaatataagtcagaagctgaaagatactataaagagttaaaggaacgaatggaaaagtttggactggagctggaaagtagtaaaagcagactaattgaatttgggagatttgcagagcagaatcgtagagcaagaggagaatgtaagcctgaaacatttgattttctggggtttaccttctactgtagcaaaactcgaaagggaggtttcgtgccaaaggtacagacttcaagaaagaagtttgagcaaaaggttagagcatacaagaactggatttacgataatcgaaatcgaccaatgcgagaaataattaaagagttgaacgtaaaactaattggacactatcgatattatggtgttacatggaattttcggaagataacaacattcctgcatagagtacaacagtttctattcaaagccatgaatcggagaggttgtagacgggcatacacatggaatggatttgtggaaatgctcaagtattacccattagcaaaacctaaaacgtactattgtttatattgaagcgaatgttactatgaggagccgtatgcgggaaagccgcacgtacggatctgtgaggggctaagattgagaggtcttagtctactcgactgtagaattcaaaaatttaatatgaaatgtgagatagagcgtatggaaataatctatacgttctattttttttgcctttttgaaaaaagtgattaaaaaactattgacattttgttactggaaagaccgcaaaatctattttgattagctgtggtgcgaggttggcaccatttgacatcaaggagctgcgtgacctgactgcttatgatgaactggagcttgatacactgggggagaaaaagacagcactgtttgtcattatctccgataccgatgcgacattcaatttcattgtaaaggaattgcttgcaaagctggcagaatataagccacttgccaaaatcgaggagattgaggaacagaattacaacatgattgatgacagactcaacaatggcgtggagaaattcaatcgtgaggaagaaaagaaagaacaggcggaaaaccgcaggctcgtttttccttaaaggagcgtctggcggctaagcagaaggaagtggcacagggcaagaaagattccaaagagcagaataaaaatatggtagtcattaggtgtcccttttgactaccgtttttttattaaaaattaaagaggagccggatcactccgactcctccaagtatgtgtccgcaaacacataccccaattgctatctataatatactataggcaggtaaaatatgcaagcattatatggaattttttaagatgtttaagcgagagaacaaatcaggatgaatcgaaatagctgaaacattcgggtttacagaagattcgtattctcttgtaatcttttcaaattcacggatggatgatttgatctctgttttagagactttcagtaattttaagtagtaacagataaggataatgtaatcaccgatagtcttgaaatttatgtacggcatcccccatttctaaaatcaggcattgtttcattggtcttgaaggatccatttttttgaaacgggtatcatataccacatcgttgtgagcaatggcattttgtatggagccttgaagatttagtttgttgttctggtatttcttttttatatcttcacgggttccggctggtgcatttttgtagctgctgattgctttatcgtacatatcatagatactgctggaatcaatttctgacatagtggtgttcaaagcaatatttttaagcgcagtttctataaacatcatttttccatataaaagagattttaattttgtatcatattgtatggttgcgttaatctcattatatgaagtgaatggaagtctgttagagaaagatacaaaaaaacgatatcctttatattagtgaaaatatccggtattgattagttgttgcttttgtgaactccctgagatggaaattccattatccctaagatgccgcattaaagaatcaggtgatttacaatctgtatgttctttttgaatgataagaacaggatacaatataatgaccagtgcaagcagaataaaggataagtgtgttgccagaggcagctacctgcttacacattctgatgatgcctcaaaaatgaggaatcttttaatcattttaagtgcataacccgttattatatatatagatattcaatggaaaggagcctgatgcgtgttgagtgatgacgaattagtggaacagattctacttggaaatgaaaatgcagcagaagaattgataaaacgctattatacatctattttacgttactgtaggtggcattgctctaatctggaaaaagcagaagacctgactcaggaaacatttttgaagttgtttaagaatttatccggatataaagggaaaaagaaatttaaggcttatctatacacaattgcaaatcatttatgtattgatgaaagtaggaaggttgagttttatccattagaagatgaagaaaatatagtgcatgagtataacgacatagttcggctagaggatagggcagagataagctattttttgaattttttatcatcagaacaaagggaagcagtcattctacgctttggagaacaacttagttttggagagattgcaaaagtgatgggatgcaatatgcgaacagcacaaagcagggttcgtaatgctttaaaaattatgagaaaggagcaggaaaatgaaagataaaaatttgaaggtctatttacagcaatctttaggagaggaagtacagcctaaaagattagaggaaacgattaagctttgcactgaaattgtacgagaacaggaagtgactagggtagaaccgaggacaggtttctttcactatctttcagatgtatttcgctttgaaggtattccaatatttggtttgcaggcagtaacgttatttatagtttgtttaacaattgctagcattgcagacgtgccaaagaatataccaatttttatgccgctgtttgtattggctatcataccagcaatttttaaaagccagtattatggaatgagcgagattgaagcggtaacaagagcttctggtgcccaaatcacgttagcaaagctggttttggtcggggcagctaatttggtgtgtataacaattcttttgtgtatggaagtttatttgcaaaattcttataaagagattggacagatggtcctatactgcctggttccgtacttagtgtgtatggttgcgttgctacgtttgatccgtttgcaaaagaaacagagtttacagatatgtgcgattgtaatgctgggttcctgcatttgttggggtatgtcagcaagaatattgccatggttatatgaaacatcagcagtgggtgtgtggattgttacatttttgatttttgctatgttctttataaatgaaattcattatattgcagagatgagaaaggaaggaaaaatgtatggaattgtcgcttgatcgtttaacaaaacagtatggcaggaaaatagcggtagattgtgttagtgcaaccttaaagccgggagtatatggtcttttgggggctaacggtgcaggtaaaacaacattgatgcgtatgctatgtgctgttttggagtcaacctcaggggaggtattgctggatggaaaagaagtaacttcgatgggggcagattaccggaatgtgttgggttatttaccacaggattttggatattatccaaattatactgcggtggagttcttaatgtatattgcagcactgaaaggaataccgaagaatgttgcaaaaaaacgtgtgactgaattgttggaagtggttgatttaagccatgtggcaaacaaaaaagtaaaaactttttccggtggtatgaaacaaagagtaggaattgcacaggcgttacttaataatccgaaaattttgattttggatgagccgactgcaggacttgatccgaaagagcgtgtccgttttcgtaatctgctctcagagtatgcaggcgataaaattgtaattctttccacacatattgtatcggatatagaagcaatagcagatgaagtgctattgatgaaaaaaggaaaatttgtattgcagggtacggttcctgagttgattcacaaggcaaatggtaaggtttgggagctttctgtttctccacaagaagctagacaatggcagacaaaaacaacggttgctaatttacggcacgaaggaaaagaaattatattgcgtattatttcagacaatatgcctagtgagcgagcggtgccttgtgaagctacattggaagatctttatttattttatttttccacagaggaaggagtgaaatagaatggaactattttggttagagcataaaaagttatggcgaaagaaaattgttaaaatatgtgtgttgttgtgttttgtttattgtgtaatttttggaagcatactttcgtttcaatggttcggttttggcagttcagatgactatacaagtgcttttggcaataattttgatggatatacagtaataaaggatagtcaggaatatgcactttcatttggtggagaattgacggatgaaaccttgcagaaaatagtaagtgattatcagcaaatggaagctgacggtatggaggaagaactggaaaagacagactggcagatagttaatagttggctcggaacattgtatccggagcttcgagataccagtaattataaaacgatgataagctatgttgatccggataaattaacaggcttctatgaaagaagacagcaggtgcttgatgagtttttggaggtcagtggtcaggtaggagctgaaaaagagtttttacatcagatagagagaaaggtagaaaaaccatttcgttatgagtgggtagaaggctggtcaacgcttcttggtagtatggttgcggatctgggagttgtgatggctttgtttctcggtattgttttatcctctttatttgcgggcgaatggcatgataatacaagcacactagtattgacgactcgaaatggttgggggaaaatcgctcttgccaaaattcttactggtttagcgtttacagtggagttatttgcattacttgctgtttcaaatgttatatcacagttgttttttatgggaactgccggatgggatatgccgattcagaatatcaagctgattgctattgcacctatgaatatgctgcaggcagaaatttatgaatatgcttttgtactgcttggagcaataggttttgccggaattgttatgtttatatcagcggctgtaaaaaataatgtacttaccttactgcttagtctggctgttgtatatggaccaatgatgattgtagaatatcttccttatgaaatgcaaaaagcattggatttaataccattggtaggaagttcaacagatattttcagaactaatacttctcgtatttttgggaagcttatctggtcaccatatctacttattactattcctgtcttgattggtattctatgtatgccattcgctataaagagctggtcaagaaggatgaaggcataaataacaatatggcaaagaaaagagataaaaaaataagttgcgagggaaaatgtttgagaggaattatcatagtttgtttgattaggtcaagacgcttcatgagagaatctacggagcgttctggtatttctggtttcttgatgtggcatttggcagccaacttatccataagagagttgatcacagatgcacgagagaaaagcatagggccagcgatgttgttttctacaggtatctctgcaggtcttgtcagaatttcatcggcaaaatccatattgatggccgtatgtgcatccatccaagtttctgcatccatgagatgggatagcttggtacgactcataccggtcttgatttcgtaggtttctctgtttcagatagaagggcacggttgatggactgttcccaacggacaatccaaggttccaaggtgtacttcacaaattcgagagattgctgctcaatattagaaaagatgcgtcatcaaagtctctcggaagacaaaggacgtcatttctggatttggctcatcgtgaatcagtcgatacagaggatgcttgattgccttttctttactaccggagtcagtatacttataaacatggaccggcagtcctgcaatggaccccgaaagaatcctgacgcaggcatagactgtagtcatttgcatggcacttcgttcattgacggctttgtcagagttgcttccaccaaagagaaaacgataggagctgccattggtgctattggtgggcttgtctctggaatgaaatagccccgataaaaatcccataaatattcctttctgccttaagaggcgtataaaattcaaagttacgtcacaaaataatttgcgcaaatgcttgcaattgcaagcaaaagcgaacataataaagaaaagggaggcgatactatggcaaatacatccgctgtttatgcaagaatagatacgaatctcaaggacaatgctgagagtattctttctcagcttggcatttctccatccagtgcaattcagatgctttatagccagatcgtactgaaaaaaggtatgccgtttgaattgaaacttccttcttctaagccattagctgttggtgcaatgaccagagaagaacttgatgcagaactccagaagggtgttgattccatcaaagaaggaaaggtatattctgcagatgaagtcgacgcggtacttgcaaaggagtttggcatatgacggatagctataatgtcggctattctgtagatgcacttggtgatttacgtaaaatctattcgtatattgcgaatgaacttcttgttccggagacagccgcagctcagctggggcgcatacgaaaggaagttcgttcattggattttatgccagctcgttatacgttagttgaatgggagccttggcattcgatgaaaatgcatcagcttccggtagacaactttattgtgtattatcttgtcgatgataaagagaggacagttctgcttctgggcaagtagctcagtattgcctggatccagtttcaggagcttctcgacatccttgagctgactctgcgtattcttgatttctgaattgacaccctttaaggcactctgaagcttggtagtatcgccaccgatctcgaccgtgatacccttaattctacttcccgccataacgcacctcctccctgcaaaatgggcataaaaattgcccggcatttctgccgagcataaagaaagcaccgatcagatttctccgaccgatgctaataaattgctattctattgagatttacaaacaggaagttataaacatctttgcaaatataccatatctattaactgtacaccacactcataaattgggtggtcataattgtccgtaaagaaattcggaatattatgagaacggacaaatccgcattcttcataaaatggtacggtcaacgggctgtcacctgttccaacttgcaaaacagaatattcatctgcatatttactggcaagaaaatcaattagtgctttcccatagccctttccctgattttctggatcgactgcgatattcttgatttcaagtattgcgttaccttcatcggtgacaacacattcagcttttacattaccatcttcaagtacatacatattacctttttcaagatagcgatcaaccatgctctcctgttcatcagctaatagcaataatgatataaactgctttttattttcattcacttctctgattttcatatccattactccgtcaaactggaagtttcacctgtgttgttaaattggggtttactctttgaaatcactcttaagaactgcatactgcgcagtgtcaataaacgtgtcctttttgtaatacttttgtctagcaattccttcaaaccgcattccacactttgttaatacatgtacagatgcaacatttccatcaaacacttctgcctgaacacgatttaattcaatctcatcaaatgcatattttagtacagcttgaagcacttccgtcattataccttgtccccaatactgtggcgaaagcatatagcatgtatctgacataaaacatgattcttcaacatttcccaaattaatcgttccaatcaaatcatgattttctttccattcaattacccaatgaaaatatgtatcagattcataattatctgcccatttatgtaccttttctttatatatttccatatccgttacgggattgaacggaaagtacctgcaaacttcttcgtattttgcccagttttcatacatcatttgataatcgtctggaacaattcttctcaatatacaacgttctgtatctattatttttgtaccaattttattcattgcactcctccacaacttccgatttgtacttatttcttaaacagctcagaatgtggaccaaggcgataaagcatcaaaacaagaacatctccacaaatctcataaataagcagccagtccggttcgatgtgacactcacgcgtacctttgtagtttcctgtaaggtcatgatccctgtattttgcatccagcgtaccgccattcgccagaatatcgattacctcaaacagcttatcaagatctttattttgcttttttgcaagcttcaaatcctttttaaactgattggtaaactgaatgtcgtatttcatacatcgagagctgccttaagcgcatccatactggaataacgcggagcagaaggatccttcatcatttttcggccttcctcaatggcagcggctgtagtatcatttggtacttccagttttaattcaaaaggaataccatgctcacggatagcggttctcaggaatatatttatagcagttgtcatattcagaccaagctcattgaagatttcctccgcctggtccttgattgccttgtctgtacgaatatttaaattagttgttgccatacagaacacctccattcaagtatagtatactcaaatgcgcgtctaatgtcaacacactgtcattatataagatacatacctaaaatgaaaaagatgcaatttctgatttttatggtatattgggaataaaatgatgtgatcgtttatgcatacacaaaacagaaaggggtccgccatggatataacaggagtaggaaacctatcatatttatataattatggaatttcggacagcgataccagacatgtcacaggaaaagaaaacggcatcggaagcgtagatgaaaatgggaaacagaaggaatgccagacctgtaaaaaccgcaaatatgtcgacggatcagatgaagcaaatgtatcgtttaagagtgccgcgcatgtttcctaaaaagatttaaaggtaaccgatgggataaaggcgcgggaggatcatgtggatatgcaggtgtaggcgatgtatgtagtttacattgactaactggtataacagctgttgccctgtatgcaccagtcaaagttgaaaattgcataaatggcagaaatatgttaccataaacatagactattgacagaaggtatatggggtggaagcgatggaaaaacaggaattttgtatggaaaaatctcagatatttcaggagatgatcagtcgtatttcaaaattatctcaggacagttatttaatggttactgatatgcagcataatttaacatttgttccagaaagtactgcagaatttctggggattccatcgggatggtgtgaagatggatataaaatagtgctggaaaagagcgtacacccatatgactgcccggaatatacggaagagatgaaaaaacgtctgcgggggatcaatctggagaacgatctgtacatccgtatgggaaaagacaaaaagtatgtgatgacgcagattataacggatatgattttagagcagggcaaaaacagatattttattgttctgcttcggaatcagaatgtgattccggaaattgatccgttgacggatctttatggtcaggtcaaatttgaaaaagatattgtggattatattcagcagggacgaaaagtagctgttttggaaattgaaattgatcatatgaatgatatcaatatattgtacggaacaaattacagcgaccggattcaaaaggttcttgcataccggtttatttacatgatggatgcagataaagcagtttatcgtatgggaaattccaattacgcatttattttgagggatgccagccgtgaagaggctgcggcatttctggagaagattcgcgcgcggctggaggaaagtgtcgtcttggaaaacaaccattttgacttgaagatatatgccagcgggataattcttgatcattatgagggagaaatttccacggtacagagtaagctggaatatgttttaggaaaaatgcgtaccagacgggatcataagttaatgttctttaatgatctggtacagatcaatggggacgtggatctggatctgatgaagataattcatcagtctgtgctgaaccaatgtgacggattttatgtggagtatcagcctgtcgtacatgcacagacaggagagattgccggagcggaagcactggtccgctggaaaaaagagccatatggtattgtgccaccgggaatgtttattgattggctggaaagtaatccatgtatgtatgatctgggaaattttgttttgaaacaggcattgacggatgctgtggagtttcgaaaatcaaatccggatttttttattaatgtcaatatgtccgcaaaacagctggaaaggaaaacgttctgtggtgttgtcatggcattgttgaaagaaaccggttttccggcggggcagttgtgtctggaactgacagagcggtgtagaagcatgccggtcagcgttatggaagaaaaactgttgtacctcaaacaacatggagtgagacttgcaatggatgattacggtacgggaagtgcatcttcaagtgtcctgctgcagaccccgatggatgagataaagattgacatgagttttatccgtggaattacggataatcagaccaaacaggcactggtgcgcagcatggttgattttgcaaataaagcggatttaaagagctgcctggaaggggtagaggatgaaaagctgcagaattatctgcgttcctttggagccacatggtttcaggggtattattattccagaccggttcaggcagctgcaatgcaaaaattgttaaacatggaaaattgataattagtcggtgatgagcagatcaacgccggctttttcatagatttcttttgtattttcggataatccggagtcggtgattaccagattcagatcatcaatagaggcatagctggagatggatgaggtgtcaaatttggtgtggtcaatcaatgcaattgttttagcagaagccttgatacacatgcgttttaaatctgcttcgtagatactgaaatcggtaagtccgttttcaacggagaagccgcgtgcagagacaaatgcaatgtccgtatgaattttctgtagcagatccacaccgaggagaccttcaatggaagaagaggcagaggtaacgattccaccggtcaggataacggtgatcccggggatatccttcagagccagtgcaaggtcaatgccgtttgtgataacggtaagttctgtaaagccggtcagtttcatgccaagtgtataggcagtggagctggcatccaaaaagatgcacatgtgatcttttaccatgtggatggcatttgcagcaattgcctctttttcttttttattttccagtgcacgttcatgaaagaaataggcttttccggtaagttctttattgtctgcagagttatcgtggtagagtgcgcctccatgtgttttggtcagaagtttttctttatccatctggtttaaatcggtacggatggttgtggtggaaactccaagcatttcactgagttcatttgtggttgcttttcggttttgtttcaaatattccaatataagtttctgacgttctaattgcagcatgatgattttttatactcctttatatttacgaaaacacagatttcgaaagtttatatataggatactatacatcggaattgcattttttgccagtgaaaagtgaaaacaaaaaaattggcaaagaagtggatgaaaatcagcagctgtggtatgataagaaaaaagcataaggaggggtttttattctaaaagagtgggaaaaatccgaaaaaccatcggaggaggaaattaaggcacggctggaagcggtaaaagagaaactggcacggcagcagcttttgatcaaagagaagaaagtaccggttcttgttgtgcttgaaggctggggaacggccggaaaaggttatgcaatcggtcagatcatccagaatattgatccgcgtttctttaaggtggtatcgatgcagaaaaagacggaggatgacaagagaaaaccgtttttgtaccggcattttgccaaaattccggaagccggacagtttgtatttctggatacggcatggatggatgagattacggaggagcgtctgcacggaaccatttccgaggatgtatatgccaaccggattgaaagtgtccgccggtttgaacggcagcttacagacaatggctatctggtcatgaaattctttctgcatatttcaaaaaaggaacagtcacggcgtattgcacagctggagcatcagaaggacacaacatggcgtgtcagcaaaaaagatctgtggcagaatgaacattatgagaaatgtatggatgtattttccggatatctgaaaaatacaaatatgccatccgcaccctggtatatcattgatgcaaagtccagaaaatggacagaagtacagattcttgagacgcttacccaggggattgagattgctctgagtaatcaccagatggcggttccgcttctgcagaatgtatttccgttgaaaaaaatgccgcttctttgtgacattccgttggacaagtgtatggaggaggatgtctataaaaaggaattaaagcagcttcagcagagacttggagaactgcacaatcgtctgtatcgtaagaaagtgccggtcatcattgcctatgaagggtgggatgcagccggaaaaggcggaaatatcaagcggattacgggagcacttgatccgcgtggatatgaggttcatccgattgcaagtcccgagccgcatgagaaagcaagacattatctgtggcgtttctggacaaggcttccgcgtaccgggcatattgcaatctttgaccgaacgtggtatgggcgtgtgatggtcgaacgtctggaagggttttgcagcgagaatgactggatgcgtgcgtacaatgaaattaatgagtttgagaaggaactgcacgactggggagccgtgatcatcaaattctgggtgcagatcgacaaagatacgcagcttgcccgttttaccgatcggcagaacacgcccgaaaagcaatggaagattacagaggaagactggcgcaaccgtgataagtgggatgcgtatgagggggcagtcaatgagatgattcaaaagacgagcactacctatgcaccgtggcatatcttagaatccgtagataaaaaatatgcacggattaaagcattaaggatcgtgattgctgaactggaaaaagtgttagactgactggaaaaataaaaaaggaataccccggcaaacggaatttccgttgccggggtatttttgcgacttatgatgaaacatcgcagaattatgaatttgcttttttcaggtttttctgtgctgtagaaagcatcagcttgatacggttgagctggttaacttctgatgcacccggatcataatcgattgcaacgatatttgcgcctggatattcgtgacgaatttccttaatgacacctttaccgacgatatggtttggcaggcaggcaaatggctgcgcacagacgatgttggttgctccctgtgcaatcagttcaagcatttctccagttaagaaccagccttcgccggtctggttaccgcaggagacgatatgctctgcctgttttgccagatcctgaatatatgcagttggctcaaaatgtttactctttgcaagttcatcccttgcatccttgcgcagccactcaaagaagcggatgagcatattgttgatgcgcttggattttgcggtagctccaagataatctgccttgaaattctgattgtagcagcagtacagtaagaaatccgtcagatccggtacgactgcttccgcaccttcggattcgagcagatccacaatatagttgttggcagccggaaggaacttgacaaggatctctccaaccacaccgacacgcggctttttctcatccgtcattggcagattgtcaaagtcgcggatgatctgacggcacattttgcgatatttacggtgggacagaatcttggtgttgccaacaaagtcaatgacacgttttttccatttttcgtgtaatgcgttggcagatcccggtaccttttcgtatgggcgcacacggtagagacagcgcatgaagatgtctccgaattccagagcgtacagaccatgctggatcaggcttggtgtgagtttaaatcccggatttttctccagaccgaccatgttgatggagatgaccggaatatccgggtggccggctttggtcagtgcgcggcggataaatccaatgtagttggtcgcacgacagccaccaccggtctgtgagatcaggattgctgttttgctcaggtcatatttgccggacattaccgcactcataatctgtccgatgacaatcagggacggataacatgcatcgttatttacatactttaaaccgacatcgacacattctctggacggaacatctgggatgaccagattgtagcctgcggcacggaatgccggaacgagaagttcaaaatggatcggtgacatctgtggacagatgatagtgtaatctttacgcatttcctcagtaaagataacgcgctcgtaatttgccggcttgatttcgcgtttttcatgttttttctctttgacacgaattgcagccagaagcgaacggatacggatacgggcagcaccgaggttgttgacttcgtcaatctttaagcatgtataaatttttccggaattggtcagaatatcgctgacacagtcggttgttacggcatccagtccgcagccgaaggagttcagctggatgaggtccagatcatccctggtcttaacgtagtttgcggcggagtacagccggctgtggtacatccactgatccatgacaataagcgggcgttccagattccccagatgggaaatggaatcttctgtcagtacacacataccgtaggaagtaatcatttccggaataccgtgattgatttccggatcaacatggtatggacgaccggccagcacgataccgcggcgatggtgttcttccatatatttcaatacttcttcgcccttcttctgcatctccagacgggtcatggcaagttctttccagccttcggatacggcatcacgtacttcggcttccggaatatggaattctttcttaaaacagtctacgagctgtttggaaaggacttcttcgtttgtaaacgccatgaacgggtttaagaaccgcatctgtccactcgtaatttcctcaacattgtttttaatgttttcggaataagaagttacgatcgggcagttgtagtggttgtttgcatccggaaactcgttgcgctcgtaaggaatcgccggatagaaaataaaatctacattctggtggatcagccaggaaatatgaccgtgcgccagtttcgccgggtagcattcggattcgcttggaatagaatcaatgccgagttcgtagatttttcgtgtggactgcggagagagaaccacacggaaaccgagcttcttaaagaacgttgcccagaacggatagttttcatacatgttcagtacacgcggaagtccgacggtcccgcgggttgcttcggcttctgacagaggttcataagcaaaaatacgtttgttcttatattcgaagaggtttggaatattctctttgtttttttcttttccaagtccgcgctcacagcggtttccggtaatatactgacggttgtctgaaaacttattgatcgtcagcagacagtggtttgtacatccctggcagcgtgcaagcttggtagtgtaggacagtttattgatctgttcaatggacagcatcgtcgtctgatagccggcttcgtgacgttcgcgggcaatcagtgcggcaccgaaagcacccatgattccggcaatgtccggacgggttgcgtggacaccggcaattttttcaaaactgcgcagaacggcgtcattgtagaaagtaccaccctgaacaacaatattttctcccagatctttggcatcggacagtttgatcaccttaaataatgcgtttttgattacagagtaggcaagtccggcagagatatcggcaacggaggcgccttccttttgtgcctgttttacctttgagttcataaatacggtacagcgggtaccaagatcaatcggatgtttggcaaacagtgcttctttggcgaaatcctgcaccgtgaagtttaaggattttgcaaaagtttcaatgaaagaaccgcagccggaagaacatgcttcgtttaactgaaccgaatctacggtctggttcttgatcttgatgcatttcatgtcctgaccgccgatgtctaaaatacagtcaacttttggatcaaagaaagcggcggcatagtaatgggcgacggtttctacctcgccgtcatcaagcatcaatgcagctttcaaaagagcttccccgtatccggtggagcaggagtgtacaatgtgcgcactctccggaagcagacggtaaatttcctgaatggaacggatggcagttgcaagcgggcttccgttattgttgtcatagaatgaatacagaagttttccgtcctcgctgacaagtgcgatctttgttgtcgtggaacctgcgtcaataccgagatagcagtttccggaatagtttttcaggtcaccggtttctacatgattgtttccgtgccggctggtaaaagcatcgtaatcttcctggctggcaaacagcgggtccagacgggcaacttcaaactccagcttaatgccggtggaaagacgctgctgcagagatcctaaagtggtctctacgtcttctttataatttaatgcggaaccgatcgctgcaaacagatgcgaattttccggtgtaattgcgtgctcatcatcgagatttaacgtgcggataaacgctgctttcagttcggataaaaagtgcagaggaccaccgagaaatgccacatgtccgcggatcggtttaccacaggcaagtccactgattgtctgattgacaaccgcctggaaaatagaggcagacagatcttcgcgagttgcaccctcattgatgagcggctgaatatctgtcttggcaaatacaccacagcgcgctgcaatcggatagattgctttataatttttggcatattcatttaatccggaagcatcggtctggatcagggatgccatctgatcaatgaacgaacctgtaccgccggcacagataccgttcatacgctgttcgacattaccgccttcaaaatagatgatcttggcatcttctccgccgagctcgattgcaacatcggtctgtggcgcataatgagtgagagcagtggatactgcaataacctcctgcgtaaacggaacctccagatgctttgcaagggtcagtccgcctgatccggtaataacaggagaaacagaaagatcccccagttcgttggatgctttggcaattaaggacgccagtgtctcctgaatatttgcaaaatgacgctcgtaatcggaaaacaggatgttgtcctgtgagtcgaggattgcaattttgacggtggtggaaccaatatcaattccaagtttatgtaactgcttgtcactcataaatgtaacctccatgtgtaagtaactaaacttattataaataagtatgatttcaaaacaaaacctaaaacattatacgacaagaattgacaaaagacaacgactgaaaacataaagattttataaaatgttggaaagaacgtgccgctgcgttgacaagagggatttgaaaaccgtataattggttgacagaaaggtcagaagtgaccgtaaccatacatacactattctatgtagacaggagacagatttatgaactggatggataaactggaacgcaaatggggacgacatgcggtcgccaatctgagcagatattttgtacttgcgcaggtgattggatacgtggtacagctgacggcacccggactcatgagttatatgaattttgatatgggcagtattctgcacggacagatctggagaattgtgacatggatttttacaccgacggcatcgctggatgtttttggaatcttatttctgttctgtgtgcttatgtggggcagttcgctggaatccatgcttggaacattccgcatgaatgtatttttgtggggaagtgtgattttgtgtgacattgtgggcgcgatcgtatatgttgttacgcggattctgctgggatatggtttttctccgtatctgtccacgtattatattctgatgtccatgctgctggcgctggccatgtgcatgccggagggagaggtacgcctgtattttgtccttccgatcaggatgaaatggatgttaatttttgaactggtatatctgggatatcaggtggttcgtatattctcgatcggaattgcaagttatggaaccggaatgggaattctcgtggctgttttaaactgcgtacagattgtggttccggtactcaatatgttctggtttttccatgccatgaagacccgtttgtccggaaaacaaaagaaacgccagaaagaattccgggcacagttcagtcagcctcgtccggggtccggcattgcacgtcacaaatgtgccatctgtggtagaaccgagctgacaaatccggaattacagttccgttattgcagcaaatgcgtgggaaatcgtgaatactgtcaggatcatctgtttacccaccagcatgtaaaataaaatttagtgagtggaaaagaaaaaatcatgaagaaaaagtttttaagtgttttgcttatcgttgcggttctgataggaatggcaggtgtcagcggaacacagacagaatcaggagaacagaaagcagacaaagaacaaaagcagcaggaaaacgaacagactgcggaaacgaaagtggaaattccaccggaaaatgaggaagaacaaaagggatggatcggtgttatcttaaacggagatgagacagaagcctatacactggcacatattgacggaatccgggcagcagcagaaaatgtcagtcttccggagcaggatatcatctggaaagagcgtgtcggtgcgaatgatggctgcaaaagtgcggtaaaggatcttatcagacagggatgtgagattattattgcaaacagcgccatctatgaagaagcaataaaaagtgaagcagaaaagaatccggaagttgattttgtagttatcaacgattcaaagacacagagtacggtaacggaagacggaacagaactcacaaatctttacaatgtacatatggatacctacgaagcttcttatgtggcaggagtcacggccggaatgaaaatagcaaagctgaaggaaaagaaaaagattcccgcaaagagttttgacgaaaagaaaaatgtaaaactgggatatgtggcggcagaggcaaacgatgatgcacatgcagatattaatgcctattatctgggagtaaaggccgtctgtaaaaaggttgttttacaggtagaatacatagatgcctggaataacagtgatgcggaggcaaccgcagccggagatctgatccggagcgggtgtgtggttcttgcatccaataccgatctggatgctgttatgcagatggttgaaaatgcaaaagaaagcggaaaatgcgtatacgcggttggaagaaactctgatatgcgtcagatggccggaaaggccgtgctgacttcggttgtcagtgtgtggtcggtttattatacagagctgtttgatgcaaagctgaatggccgctatatggaacagaactggaatggaggatatgcacagggagcggttacaatttctacactgggaaaaagtgcatcctccggaaccggtgacagagtgaaaaaaacggaagaaaaaataaaaaacgggaagaaacagattgcatatttttcaacacgtgcgctggacggaattctggaatccgaaaaaggacaggagcaatagcgtacacaggcgcgttttggttgacaaatatcgggaatatccctataattattcttatttgaggagtgctggaggaatagacatatggaaaatgaagcggtttccaagaattttattgaacagattattgaaaaggacctggcagagggacattgtgagacggtaaaaacccgttttccaccggagccaaacggatatctgcatatcggacatgcaaagtccattcttttaaattcagggttagcaaaaaagtacggaggagaattcaatctccgttttgatgatacaaatccgacaaaagagaaacttgagtttgtagagtctattaaggaagacgtaaaatggcttggagcagattggggagatcgcctcttctttgcatcaaattacttcgatcagatgtatgaagcagcgattaaactgataaaaaagggaaaagcatatgtatccgatctgtctgcagacgaaatccgtgagtatcgcggtactctgacagagctgggaaaagaagacccatatgccaaaagaagcgtagaggaaaatcttgcgctgtttgaagaaatgaaggaaggaaaatgtgaggatggaagtcgtgtacttcgtgcacggattgatatgacttcttccaatatcaatatgagagatccgatcctttatcgtgtggcacatatgacacatcacaataccggggacaagtggtgcatttatccaatgtacgattttgcacatccgattgaggatgcaatcgagggaataacccattccatctgtactctggagttcgaggatcacagaccgttgtatgactgggttgtgacagaacttggatataagaccagtccggaagggactccgaagcagatcgagtttgcaaaactgtatctgacaaatgttgtaaccggaaaacgttatatcaagcgtctggttgaggagaagattgtagatggatgggatgatccacgtctggtttccattgcagcgctgcgccgcaggggatatacaccggaatccattcagaaatttatcgaacttggaggtatttccaaggcaaacagttctacggattatgcaatgcttgagtactgcatccgtgaggatctgaagatgaagcgtccacgtatgatggcagttttagatccggtaaaggttgtcattgacaattatccgcagggccagacggaggaacttccggtggacaataatctggaaaatccggaactaggaaagagaaccgttccgtttaccagggaaatttatattgaacgggatgattttatggaagaaccgccgaagaaatatttccgtatgttcccgggaaatgaagtgcgtctcatgaatgcatatttcgtgaaatgtgtcggatttgaaaaggatgagagcggaaaagttacggttatccactgcacatatgacccggcatcaaaaggcggaaacagcccggatggaagaaaagtaaagggaaccattcactgggtatcggcagaacacggaaagaaagtaacggttcgcttatatgagaacctcattaatgaagaacttggtgtatataatgaagacggaagtctgaatctgaatccgaattccctgactgtcctgacagagagcattgtagagccggcattgttagaggcaaaaccatatgagagttttcagtttgtaagagaaggatttttctgcgcagattataaggattcaaagccgggagcgcctgtatttaacagaattgtttctttgaagagttcttttaagctgccgaaaaaataaagaatagacaaaaagaggcgtagaatgaatttattatcgggattggaaaaatttggtctggatcagatggatacagaccacctctttgaagaggaaaaaagtgatacacctgcacggaaagcaccggaaccggtgccaaaaaaagaaccggttcacagcgaaactgagttcttactggataaatccatccgttgtccggtatgtgataatgttttccgtacaagaatggtaaaaactggacgggtaaagcgcatggaaccggattttgatctacgtccgcgttttcagtacattgatacaaataaatatgatgtatcgtcctgcccacagtgcggatatacggcgatgaaccgctattttacccatttgtctaccggtcaggtcaagatgattgaagaaggggtatgtcataagttcaaagggcagaagcagcccaaagaagaaccgatggagccgtattcttacgaaaaagccattgagcggtataaactggctttatataatacactggtgaaaaagggaaagaacagtgaaaaggcatatgagtgcctaaagatatcctggctgtaccgcggctggattgaggagctttccaaggcaaaaaagaaagatgaaaaaacacttgccgaatgccggaaagaagaagccacgtattatgaacaggcatatgagggatttttaaaagcgattgcatccgaaaatttcccaatgtgcggaatggaagaaagtaccgtaaacctgttgatggcgaatatagcttataaacttggaaaggtggacattgcatccagattcatttccatgattctgacttcacaggcagcttcccgagtggcaaaagaccgagcgatgcttttaaaagaagagattattgcaaaactgcacggcaaaggataatctatggctggaaaattttatgcggtaaaaaagggaaaagttccgggaatttatacctcatgggatgcatgtaaaagtatggtgcatggatttccgggagctgtctataaagggtttgcgacacgcgcagaagcggaacagtttctggaagaaaaaaaagaggaacaaaaggaaccggaaaattatgcgtttgtcgacggttcgtttaacagtgctacttccgtctatggatatggcggatttctcgtgacaaagggagaacgtcacgtgatcagcggaagcggcaatgatccccagatggcatcgatgcgcaatgtggcaggagaggtgttaggcagcatggctgcagtaaaagaagctgttgccatgggacttaccgacttaaccatttattatgactatatgggaatagagatgtgggcaaccggagcctggaagcggaacaaacagggaacgattgcctattatgattttatacagtccgtgaatgataaaatttcccttcattttgtgaaagtgaaaggacattccggggtagaaggaaatgaagaggcggaccggttggcaagacttgctgccggggtagattagacagacaggggtgacaaagtgagcgtatttaatgtagaactgaaaaaagtggtggatgacagttacgatattgagatggggtatcgtctggaggatcaactggtagaggatttagagaccggtcttctgggaaaaatcaggaagtttgccgtgatcacggattccaatgtactggatctgtatgcaaaaccaatcagtgaaaagctgagcaaggctggatttaaagtggaactgttcgtatttcccgcaggagaaaaaagtaagaccagacagacgaaggcgaagattgaagatgccatgctggaaaaagggttccgcagagattgtgctgtgattgcaatcggcggaggtgttgttacggatctggcaggatttctggcaggaacatatggcagaggcgtaccgtttatcaattatgcgaccacacttctggctgctgcagatgcatccgtgggcggaaagactgccgttgatacaccgcttgcaacgaatctgattggacttttcaatcagccgcgcaaggtctacattgatattgccgcatggaaaacccttccgaaacgtcagatggcaagcggcatggcagagaccatcaagcatgcatgtctggcgagccgtgaaatgtttgagtttatcgaggaaaacttggatgatattatgagtttccagaagtttgcctgcgaatatatcgcagagaacaactgtaagatcaagtatgatgttgttatgaaagacgagagagaaagcggactgcgcgaagtcctgaatttaggacacacggtgggacgcgccattgaaactgtcagtgactaccggcttctgcacggcgaggcactttccatcggaatggcggctatggtactgctttcggcacgccttggctatatgtcagaggaagaggcagagcgtgtgactaagctgtatgcgcgtgtgggacttccgacaagaattccggattatattgatcgtgaggctctggttaagaagctttataccgacaaaaaggtgcgtgacggaaagttacgctttgtgatcgaaaaaggcattggcgatgtagtggagtttgcaccgaatgtgtatgccaagccgatcgaggagagtctggcaagagagattattatggaactgtaaaggttatacgaggacgatgggctgtcggtattcgtttggtaattcggtctgtatctgcatggaagatgtagtgcggtacagatcagcacaggctacatcgtgtaaaaaacgtttgtatgcaattccatgaaggatagaagaagcatctgcaactttggtaatcaaaggaacggatgcttcttttttgatggcagaaagaagcacagaggaatccctgcggaaaccaagcacacgcagatatggaatgccatccggctgccagagcgcagcataatcgtcctgccggatgttgagcaggatgtggagcagtgcacggcagatgcgtgtgtatgttgtatttttgctttttaagagatcggcaaactgcgaaaagcttaaaaaatgttcaagctgctgtgtgatccggtgggacagatccttgccacagtctgcaaagccagcatagcctccatcgtacagtgcccataaccgggtgtagagagcctgagaaaaagcatccgtgtccagaagaaggttctgctgtgccaaagtggcaaggagggaggcggaagtatcgggaagcatctgcgaaagttcgaaatcaaagctgcctgtacttatgaacatggaatggttgtggttaccatcattttcagatggcacaagcagtgcgtttcttatggcagttgcagaggcgtaggttacgcctgtttttgtgctgtgatagccttccccgatacgttggaccggcatactggaaaaagttctgtcatgtacgctgtttatggaattccagcgggcgattgctttttcgtattctaaggccagaatattgttcggagatgccagaaaagaagaaaccgcatcagaagaaaaggaaggcagcagggaacacagtgcgtggcttcgtgcgacaggaaacggatttccctgcttcatgttataagaaaccagcatctgatagtccgaagcatttttggaaagaacttcgacaattgcctgcataagttctttttccggagtttcacagccatagcagagcgtgtcaacgacgcctgtttttccgagaagctgtacgcctccggcagcaaaatattccgcggaagcggtcgcccatacagccggaagttcgagtaccagatcggcaccgccgagaagtgccatgcgggtgcgcgtgtatttgtcggcaatggcaggaacaccgcgctgcataaaatctccgctcatggcgacgatcacaaaatctgctcctgtaaggtggcgtacggtttcaatctgatattggtgtccgttgtgaaacggattgtattcggcgataattcctgctgttttcacgtttgcctcctgttcggtcgtttcttctgtctgtttttctgttaaaatattaacacagcttttcgaggatttccacttgtataagaaggaaaatgtgtttataatggaaaaagattgtggatttccacaaaatgaataaggacaagggagaattcaaatgaacgtattagtaatcaactgcggaagctcttccctgaagtaccagctgatcaactctgattcagaagaggtacttgccaagggcttatgcgaaagaatcggaattgacggaagactggtataccagaaagagggaatggataaggagatcacggaagctccgatgccaacccacaaagaggccattcagatggttcttgatgcactgcataatccaaagagtggagcagtaaaggatctgagcgaaatcgacgcagttggacatcgtgttgtacacggtggagagaagtttgcaaagtcggtggtactgacagaagaagtgcttgcaaaggtagaagagtgtaatgaacttgcaccgttacataacccggcaaacctgatcggtatccgtgcgtgtcaggatcttatgccaaatgtaccgatggttggtgtatttgatacggcgttccatcagacaatgccaagaaaggcattcctgtacggacttccatatgaatattatgagaaatataaagtaagaagatacggattccacggaaccagccacagttttgtatccaaagcatgtgcagagtatctgaaactggatctgaaaaacagcaagattattgtagcgcatcttggaaacggagcatctgtcagtgctgtattaaatggagaatgtgtggatacttccatgggtctgactccactggagggactggttatgggaacccgttccggagatattgatccggcaatcatggaatttatcgcaaagaaagagaacctcgacatcgatggtgtcatgaatgtgttaaataaaaaatccggtgttgaaggattatccggtgtatccagtgatttccgtgatctggaagctgcttataatgaaggaaatccacgcgccattgatgcctgtgaggtatttgcttaccgtgtggcaaaatacatcggtgcatatgttgcagcaatgaatggtgtggatgcgatcgcatttactgcaggtatcggagagaatacttctttcattcgtgaaaagatcgtttcttatctgggatatctgggaatcaagcttgataagaagacaaacgatgtgcgtggcgtggaggaaattatttccacaccggattcaaaagttaccgtatgtgtcattccgaccaacgaggagcttgcaatctgccgtgagaccgtagcactggtaaaataaatgttgataaatttgttgataatttgtaaaaattagttgacaaagcaggacaccctatgtataattgtttaggtgtgaataggagaatagtgtgaaaattgatctttcaatcattacaaaatccataaacaaggaattgacacaggaggcggacatctcgctcacttcctttcgttcccgcttgggagattttcctattgttcgcaaagcgccggtgacattgcagatccgtaatgaggagaatgcagcggtattcgttaagggtacggttgatattgatgtgatgattccgtgtgcgcggtgtcttgaagaagttcggacgccgatccgttttgacatagataagaaactcactgttcaggaagagggacttgtcgatgaagagatggagaaaccggattacctgattgggtttgaactggatgtagataaacttgtctacgccgagattttggtgaactggccaatgagagttctgtgcaaggacgattgcaaaggaatttgtaaagtctgcgggatgaacttgaataagggagcctgcagttgccagagaacagagcttgatccaagaatggcagcaatccaagatatatttaacaggtttaaggaggtgtaaacaaatgtcaatttgtccaaagaataaatcttctaagggaagaagagataagagaagagcaaactggaaaatgtctgctccgaccttagtaaagtgcagcaagtgcggcgaattaatgatgccacaccgtgtatgcaagaactgcggatcttataacaaaaaagagattatcgcgcaggattaataaggataggtctttaaaaatcaagagttggcggttttgctgactcttgatttttttgtgcctgaaagagccaatttatcgttgatttatggaatgatatatagtatattttctagtagatgcataaggaggaacagaccatgcagacaatcacgaaagtagctcttgatgcaatgggcggtgataatgcaccggcagaaattgttaagggagcagttgatgcggtctcttcccgtgaagatatcaaagtttttctggttggacaggaggacgtggtaagggaagaattgcaaaagtacccatatccgcaggagcgtattgaggttgtggatgcgcctgaagtaattgagatggcagagccacccgttcaggcaattcgaaagaaaaaacagtcatccctcgttgtaggtatgaatatggtaaaacaaagagaagcggatgcatttgtttccgcaggaagttccggagcggttctggttggcggacagacgattgtcggacgcatccgtggaatcaaacgcccaccgctggcaccgatcattccgacggagaccggaatttcactgttgatcgactgtggcgcaaatgtagacgcacgaccggaacatttattacagtttgcaaagatgggttccgtttatatggaaaacgttgtggggattaagaatccgagagtggcgattgtaaatattggtgcggaagaggaaaagggaaatgctctggtaaaagaaacatttccattgttgaaagaatgtgaggatatcaattttgtcggaagtattgaggcaagagagattccacacggtggagcagatgtcattgtgtgcgaggcatttgtcggaaatgtcattttaaaattatatgaaggtctcagttcaacactgatcggtgtgatcaaggcgggactgatgagcaatttaaagagcaagatcggtgcggcactggcattgccgtcactgaaaaaaacactgaaagcatttgatgcgagccagtatggcggagcaccgcttctgggactgaatggccttgtggtaaagacccatggaagttccagggcaaaggaaattaccaattccatttaccagtgtgtgacattccgtgaagagaatattaacgaaattatcaaagaaagagttgcagattccaaaaataatgaagaagaataagaaaggaaatgaagtattatggagttcgaaaaattaaagaagattattgtggacgtattaaacgtggacgaaaatgagattacgatggataccacattcatcgatgatctgggagcggattccctggatgtattccagatcattatgggacttgaggaagaatttgatattgagattccaaacgagcaggcagaaaagattgttacagtaggggatgcggtagaacagatcaaagctgcaatgaacgaaaactaaacacagatacgaaaggagtccggtggcggactcctttgtttcagaaaggggaaagaagtgacagatattaaaaaatttcaggaagtgatcgaatatcactttcatgatgaaaaactgcttcgtcaggcactgacgcatagttcatttgccaatgagaagcacttaaagaaacattcggacaatgagagactggagtttttgggcgatgccgtgcttgagattatctccagtgaatttttgtacaaagagtatccggacaagccggaaggagaactgacaaaactgcgtgcaagcattgtctgtgaaccgacactggcactctgtaccaaggatattgctttaggagagtatcttttactcggaaaaggagaggaccagaccggaggaagaggccgcaaatctattttgtctgatgcgcttgaagctgtgatcggggcaatttatttggatggtggttttgctaatgcaaaagagtttattcataaatatattctgacagatattgaacacaaacagctcttttatgatagcaagactatcctgcaggaggttgtgcagggagaacatgagcagcttacttatgtactgactgatgagtccggtccggatcataataagagttttactgtccgtgcatgtattggagagcgtgtcattggcagcggaaccggacataccaaaaaagcggcggaacaggaggctgcatatcaggcacttctgatgcttaaaaatcagcaaaggggatagtacatgtatttaaaaagtattgaggtgcagggatttaaatcatttgcaaacaaaattgtatttgaattccaccagggaatcacgggcattgtaggaccgaacggaagtggaaaaagtaacgttgcggatgcggtgcgctgggtacttggagagcagtcggtcaagcagctgcgtgggtcttccatgcaggatgttatttttgcgggtacggagaaccggaaaccgctcagctatgcgtatgtagcgattacactggataattccgaccataaactggcaatcgactatgaggaagtcaccgttgccagacgtctgtatcgttccggagagagtgaatatctgatcaatggcagtccgtgccgactgaaagaagtttcagaattgttttatgataccggtatcggaaaagaaggatattcgatcattggacagggacagattgaccggatcttaagcggcaaaccggaagaacggcgcgaactttttgatgaggcggcaggaatagtaaagttcaaaaaacgaaaagcgactgcacaaaaaaagttagagaatgagagagacaatctggtccgtgtaaacgatattttgtcggaactggaacgccaggtggaaccgttacagctgcagtcggaaaaggcaaaaacctatttaaaaaagaagaatgagctgaaagattatgatgtcaacatgtttctcatggaaacagagagaatcgcatccgagcagcgtgaagtagaggaaaaattcaaaattgcagatgaacagctgaaagaaagcacggatgcaagggaaaagatccgccaggaatatgaccgtttgggcgaaagcatcacggaaatggacgaaaagatcaatgcaatccgggaaaatatcagcaatacgtctgtgatgaaggaaaaactcgaaagccagatccagatactggcagagcagatccatacggcagagatgacagatgaacatctgcagagccgtctggatgccattgcgcgggaacagaaggaaaaggaggaggcaaaagcttcctacgagaaagaaaaacattccggtgatgaacagcttgcacaggtacggaaacggcaggaagaagcagcacagacactggcagagatacagaaacagattgcatcctgtaatgagggaatggaacaggggcagaaagaattgtttgcgctgttaaaccgcagagcagatattcaggccaaacagcagcgttccgataccatggtggagcagatcaatatacgaaaagcagagcttggaaagcgtcttctggacaggaaaacgcaggaaacggatctggattcggttcttgcagactgcaaaaaagatctcgaagaggtcagtgcgcatatccgaaaactttcggagcaggaaaaagaattaagtgcaaaggaaaaagaatggagaactaaggcaaaagaaaatgaccgtgcattggaagaaaagcaaaacgaatttcacaggcagcagtctcgtctggagtcgcttaaaaatattgcggagcgctatgacggatacggaaacagtatccgcaaagtgatggaacagaaagaacataatccgggattactcggggttgtgtcagatctgattcaggtggataagaaatatgagattgcgattgagaccgctctgggtggaaacattcagaatattgtgacggaagatgaagcaacggcaaagaaaatgatcgcctttttaaagcagaaccgtttcggacgtgcaacatttcttccgctgaccagtgtaagcgcaagaaaaaatccgaagaatgaagcggcacggaaggagcccggagtcattggaattgccagtcagctggtaaagtgtgagcaaaagtatgaggaagtggcggcgtatctgctggggcgtgtgcttgtggcagattcgattgatcatgcgattgcacttgcaaagaagaatcattacagtttacatattgtaactctcgagggagaatatttaagccccggtggttccatgacgggtggagcatttaaaaattcatccaatctgctggcaagacgccgcgaagtggaggaactggaaacgaaaacgaatcgtctgcttcaggagattgcgcagataaaaaaccgcagggaggatcttcttacggccattgagctgaatgaggaagatctcgaacaggtgaaagaaaccctgcagaaagaatttattcgtcagaatactgcaaagatcaatgtggatcgcgcaatgcagcagaaaaatgagagtgaagaagtattttcaagtctcatgaaggaacggcagcagatggatcggcaggtagaagaaatccgtgcagatcagacaggcattaaggaggaactggaacattccagacaacaggaaacggaaatccagcatgcgaatgaagcgtttcagaagatgcttgaagaacagaaagaactggaaaataaagcggaatcggaactttccggaattcagcttgaggaagcgaatatccggcagaaagtagaatttgcccagacaaacgtggaacgtatcaatggagatctggaaaaattcgagacggaaaagaccgggcttctggagaatgcgaaaaatttcaaagaagatgtggaaaagaaacagcacgatattgcagaaatccaaaagacgatccttgcttcttcggattcccatggggaactggaacagaaacttcgtgaaagcgtagaacaaaaagaacagatgtctgcggaataccggggatttttccggaaacaggaggaaatttccgagcggtgtaacggattggataaagaagtgttccgtctgaacaaccagcgggaaaagctgaatgaatctgcagaacaacagacaaattatctgtgggaagaatatgaactgacaccgcatgcggcagcagaattaagaaacagtgaatacgaagatccgcttgctttaaagaaactgatcgcagcagtaaaggatgagatccggaagctgggaacagtcaacgtcaatgccattgaagaatacaaagaagtttcggaacgttatacgttcctgaaagggcagcatgatgatctggttgaggcagagcagacgctgctcggcatcatagaagatctcgacagtggcatgagaaaacagtttatggaaaagtttgcggaaatccagaaagaattcaatgcatcattcaagcacctgttcggcggcggacatggagctttggaactggtggaggatgaggatattctcgaatgtggcatccgcatcattgcgcagccgccgggaaagaaactgcagaatatgatgcagatgtccggtggtgagaaagcgctgacagcaattgcactgttgtttgcgattcaggcgctgaaaccttcgccgttttgtcttctggatgagatcgaagcagcgcttgatgattccaacgtctcaaggtttgcaagttacttaaataagctgacaaaaaatacacagtttattgtaattacgcacagacgtggtacaatgacagcagcggaccggttgtatggaattaccatgcaggaaaaaggtgtatcgacacttgtgtcggtagatctgattgaacatgatttgaactgattgattatgtaaaaagaaagaagcgataagaaaggaaactgatatgggagaaaagaaaggttttttcagccggcttgtcgaaggattgaccaagacaagaaataatattgtatccggaattgattcggtatttcacggtttttctaaaattgatgatgagttttacgaggaactggaagaaatcctgattatgggtgatctgggcgttaaggctaccgagtcgattctggatgatctgcgtgaaaaagtaaaggcaaaccatgtgaaagagcctgcagaatgcaaacagcttctgatcgacagcatcaaacagcagatgcaggtcggtgagacggcataccgctttgaagaagagacatccgttgtccttgtgatcggagtcaatggtgtgggaaagaccacaaccgtcggaaaacttgcaggtaaactgaaagagcagggaaaaaaggttgtgattgccggtgcggatactttccgtgcagcagcaggagatcagctcaaagagtgggcggaccgttcgggagttgatatgattggcggaacggaaggcgcagatccgggatctgtggtttatgatgcaacggctgcagcaaaggccagaaatgcagatgtgcttctggtcgatacggcaggacgtctgcacaacaagaaaaatctgatgaatgagcttggaaaaattaacaagattctcgaaaaagagtatccacaggcgtatcgggagacgctggttgtgctggatgcgacaaccggacagaatgcgctggttcaggcaaaggaattttccgatgtggcaaagatttccggaattgtgctgacaaagatggatggaacagccaagggaggaattgcggtggcaattcaggcggaacttggagtgccggtcaaatatatcggcgtgggagagaccattgatgacctccagaaatttgacccagatgaatttgtgaatgcattgtttgacgtaaaaaataaggaggacaacgatgaagatgctgacgctagataaatttgaagaagcaagtgaaaaagtaaaagaggttactcttgagacaaaacttgtatacagtgattacttaagtgaccagacaggcaataaagtatatttaaagccggagaatatgcagtttaccggtgcatacaaagtaagaggtgcttattataaaatcagcacgctctcagaggaagaacgtcagagaggactgattacagcatctgccggaaaccatgcgcagggagtggcatatgccgcaaagtgctacggctgtaaggcggtaattgtaatgccaaccaccacgcctctgatcaaggtgaatcgtaccaagagttacggtgcggaagttgtgttgtacggagatgtatatgatgaggcatgtgcacatgcactggagctggcagaaaaaaatggatatacctttattcatccgttcgatgatctggcagtggcaaccggtcagggaaccattgcaatggagatctttaaggaacttccgctggtagagtatattcttgttccgattgggggaggcggactagcaacaggcgtatccacacttgcaaagctgctcaatccaaagattaaggtgatcggtgtggagccggctggtgcaaattgtatgcaggcttcatttgcagccggaaaagtgacaacgcttccgacagtaaatacaatcgccgacggtactgccgtaaagacaccgggaagcaaaattttcccatatatccagaaaaatctggatgacattatcacggtaacggatgatgaactgatcgtaagctttctggatatggtggaaaaccacaagatgattgtagaaaattccggactgcttacagtagctgcattaaagcatttaaatgtcaaggacaagcgtgtggtatccatcttaagcggtggaaacatggatgtgatcacgatgtcctctgtggtacagcagggactgattttccgtgaccgtatctttaccgtttcggtattgcttccggataagccgggagaattggcgaaagtttccgagacactggcaaaagagcagggaaatgtcatcaaactcgaacacaatcagtttgtttccacgaaccggaatgccgcagttgaacttcggattacattggagtgttttggtaccgatcacaagaagcagattatcaaggcgctggaaaaggccggatataagccaaagatcgtaagaaccatgatttaaaaataaattacaaggtgtcaagaaaaaatacttgatatgtaaagccttggaatgctagtaaaatcagcactccgaggcttttttatatgctttttgtgacaattttgtgacaaaatataaaataaagcatgattttgtgtgattctggtgtgcgtcccggctgtagatggcagccgcacagaaagaaccgggcgaacggagcggaggccctgggtggggggtgtatttccgggcgagccgccgccaactcacccccgtaaattttccaaaaataaaaaaggcgatccggtcagaatttgattgaaagccttacagtaagatgataatataaatacatgggaaaccagagagccgggcggcttaccctctttatcggaggggctaaccctccagacgaaagaaaggagggcgttgccaatggttacatattctgatttgattcagttttgtatattcattgttgcccttgttggtctttgctataagattttcaaggataaacgaaaatagccgccaactattcgcagtagttgacggctgtttgtaaaaacagtttgtaaatttacttgagggtagccgcttctctggctttccctttttctatgttcaatataacacgtgggcgtatttttttcaaggtaaaatatcggtgttgacgataaattgttgataacgatgtgtaaattatataaaatatagtcatataaagcaaagagccatgagccgggtgtatatcatccggcttttttctgtttatggaggtatcacgatgaaagcaaacaaagcaaagattattgatctgatgtgtgcaaaagatttgacacaagaacagcttgctaaggggtgcggcgttcgtaattgcacaataacggctattttaagaggacagagggagccgacaataaaaaccataaataaaatagctgtgtgccttaattgcagccctagcgagattgtggaggtgtagggatgggaaaagtaaagcataaaatcgccgtatatgggaaaatgtacggttgcacattgccaactgtgaaaaaattggaggatgccggaacagttacagaaattataaccgttgcttataatgccggctattctgatgcagagacacaaaataacagactggcagaaattgaaaaaattgttgtggacggatacaacacgccgggagagtttcaggactggcttgttgattcaataagaaaagcctacaaaataggttatgaggaaaggagcaaagaaaaatgatcgctgttatttgtacaacaattgtatgcgttacggcttttttatgtgttgccgttatcgtaggatctaagaaataatcatctaatcaattagagccgcgcagagccgagagaaaatcccggctcttttttaatgccggaaaatgaaaggacggtgttagtcgtggctgaaaaagtagatgctattacccttgaaatcgaggcaacaacagaaaaagcagataaggggatagataagacaatagagagcctgagagccttaaaaacggctctgaatggcataaatacaaagaaattaaaacaggaaatggaaagcttcgaggatttccagaagaaactgcagacggcgttttctaatatcaaagtgtcaggaaatcccgaagaattaagaaaacaaattgcacaggtggaggctcggcttgatgcactgacaaaaaaagaaaataaattaaaaactgtatcaggaataaatgaaaattctaaacaatacagaaatttagtttatgacattgcagaagcaaaaagcacgttagaacagttatacgcggctatggataaagtaaacgcacaaaagccgcttaatttttgggaaaacccgaactggtcggagaatctgcaaaaatacggaacaacagacgagagcgttataaaatccagtctgggaacatctgaggatattgaaaaagttgaaagcgttgcaacatatgcagcaaataatataaaacaatccttttcagaagttgcacagacagaggaagaggcagcgcagaaagtcaaaaatctcggcggaaaaatgcaaggcttaaaagccatagcggaacagttaaaaacggctttttccgggattcgtgaaaaaatgtcgcttggttctggtgcggaaaagttcaacgctgatatgcaagatctgattgatggcatgaatcaggcaaagtacaccatgaaacagatggagagcggcgcaaaggcgtttgactctaccgcatacgaaagagcggcgcaggatctggcggaagcatcggcacagatgcagaaatataaaagttctttgaccggtgcaacggagcagacaagccgcctcaaaactgtactttctggcattggtggaactgtaaagggtgctttttcaaaagtggcaactatcggctccgggattgtttcagcgtgtaagaaagccgccggagcattgagagggttgaagtctcagattccaaaacttggagcagcctttggcggattaggtaagaaaataggtagcgtaacgcggttatttacgtttatggtgttgcgccgggcaattacggcattattaaacaccatgaaacagggctttgacactttggcacagtattcagcggcaaaggggacagagtttaataaaaacatttcgtctatgcaatccgggctaaagcagttaggaaatagcattgtagcagcatttgagccgcttataaatgctgtaacgcctatcatcaatgcttttatatcaaagctgacagaggcagcaaatgccatcggtcaatttttttctgcattaacaggtaagtcaacctttacccatgcaaaaaaggttgttggaaattatgccgcaagtctggataaagcaacagcgagtacaaagaaacttgcaacggctacagccgggattgatgagttaaatatattacaggacaacaacagcgataacagcggcggatctggtgcaactaatccggcggattctttcgagactgagaaagtcggggataagttcacaaatcttgcacagatgataaaagatgcatgggaaaaagcggatttttcagaaatcggcgcaatggttgcggagaagatcaacgctgcactagagggcatagactgggcgaaaatcaaagaaacatcaaagaagatagcgcagagcataggaacatttataaacggctttgttggggcgttagattggtctctggttggtactactattggcgagggtatcaatacggctttagtgtttgcaaatacgcttttaacaacaatagatttcgggcagatagggcgatcacttgcaaccggcttaaattccgccgtaaatgtgatagactggccggcggttggctctttggtgtgtaatgggttcaattctattattgatctgctttatgattttgtgtcaacttttgactttacaaaattcggggagagtataggaaccgctataacaacggcaataaaaggcattaagtggagcaaaggcggcgcagctattggaaaagctgtaacaggattatttgatacatttaacggatttgtaaagaaaacggatttcgccgcattggggaaagggattgtttcggcaatcggtggattttttaaaaatctttcttggggttcgattggttcagccttatcaaacgcaataaaagccttgtgtgattctttatatggggttgtttctggcacagattgggcagcagttccacagtatatcgttgacgctatcaaggattttttcacaggttttgactggtccggcgtctctaagagcttgggaaaacttatcggatctgctgtaaaaggtgcgattgatttagtaggcagtatctgggatatgttaaaaaaatcctggggcaatatgtccgattatttcaatacttacatcgaggatgcaggcgggaacattatcgccggattatggaacggaatcaccgatgcattgaaaaactgcggtacatggataaaaaacaacctgtttcagccttttatagatgggttcaaagatgcattcggaatacacagcccatcaaaagaaatgaagataatgggcggctatgttgtagatggttttctctctggtatctctggcaagttttcagaatgccgcgacaaagttttagagtggaccggtaaaataaaagattggttttccggtacatcattcgggaaaatatgcaaatcaacatgggagaattacgctcagaacatcataaccggttttaaggacaagataggcaatgcttatacttcgacaagagataaaatatctacgtgggcttctgatgtgaaagattatttttccggaagttctcacggctctataaactccacaacatgggcggattatgcaaacaaggttgtttctggatttagggacaaaatcggaaatgtttatacaacggtacgttccaatatttccacatgggcctcagacataaaggattatttcacaggatccggcaaaggtgcgataaacttaaccacttttagtaattatgcagacaaggttgtttctgggttccgggagaagataggaagcacatacacaacagttagggacaaaatatccacatgggcctcagatatacgcgattattttacaagcagctcacacggatctattaacagtacaaagttttcaacttttgccggtaatattataagcggatttaaaggaaaaatcacaacatcatacagtgattgtcaaaccagcattacaacatgggcgaataaagtgaaatcatggttttctgatacggcaagcgtctcatcgttccagggatttgctaaaaacgtgattcatggcttccgtgatggaatcaacagtttttatagagactgtgaggatgctgttaagtcgtgggcctctaaagtcacagactggttcaaagaaaaacttgatataaacagcccgtcaaaggtgtttgagcaattcggattgtatacggtgcagggattcaataagggcattaacaacgccggaaagacaacgaaaaaggctgtctctggatggcttgcgccgcttgataatgttgctgtgaatacgagactctctatcaatgatacagatttgagagcttgccgggcaaattatggggaagatttcagccgcgatataagtgtacagcgatacacgcataacagcataagcggagccgtacaagctgcaatcgtgacagataatccactaacggcagcatttagggagatagcagaatctgttatagttccggcaattcagaacgtagaaacacaggcaaagcggcaggcagacaaaaacgagcagactattgtggagattggaggaaagacgataacggacgcagtacgcgaacagaagagcagaaacggtttttctttccaaccaacataaaattttattgttgcaatagtgatattgcacaacaaaatataaacgaactgcgttttcaagtgtttgcaccgattacagaaaaagtgttgtttagtccgctatacaaagaacgaaccgcaatgtttaacggactaaacaatgctgattttatgggaaaaatccttgtttatttagtcaatatcttttattcttacgccgtgttattgtgatgccaacagataaaaagagatgtaaaaaatagtatttatctgctgacattcaaaagaaaggaggcgagaggatgagaaaggctcagtatactaaaccagacagaccgctgcttgtgacagtgccagagtttcagggatatacaggactcgggagaaagacagcgcaaagaatcgcggaggaagcaggtgcgatagtcaaagttggaagattgacaaaggttaatctaaaaaaggcggaggcatatattgatcaagctaatgaattgtaacggttgcattactcagtgttacacattgtaaaatgtaacggttagagttcattactagaaaggaggacgcttggaagggtggataaagttacacagaaagacgcttgacaatccgattgttatgaaagactccgctcatttcgcagtatgggcatacttgttattgaatgctacgcacgcagagaaacaggcaatatttaagggtaagaggattgtattacaaccgggacagctcataacgggttgtatctccatatctgacaaactaaagttgaacgaaagcaaggtcaggagggttctaaccgactttcagaatgacggacagattgacagacaaacaagcaataaaaactcccttatttcaatacttaattggggattgtaccaaaaaagtgacggacaaaatgacggaaaaaatgacagacaaccgacagacaaccgacagaccaaaagccaaaaagtgacgacaaacaagaatgtttttaaacaagaaagtaagaatgaaagaaacagtatatattatcccactaataaattagtgggatcgtcagacataaagaagtctgacgttccaacacttacagaaacagaggcattgtctgcggctaatgatgtttcagaaaagcgaggatttccggaagaactgaaaaaagcctttaacagatggataacgtacaagtacaccagaggggacgcatttaaaaactattacgctgttgataaagtcggacaggctatagaaagtcattcaaaggattacgcagggcgtgttaatgaacgaagtacaaaccaagttgttaaattgattgattgttgtatcgctggaaaatcaaaaagtgtttgctggtcacagatttacagcatttaacgagaggagggcacaaagtgaataatatgcagaaatggaaagccggatggaacggacctgatcagaagattaaatacagaaaagcagcaagcagagaagaaatagacgaccttgtttttcttagccgtgttatttctgtaattcctgaggatgattgtacagagtttatattcttagagtgtgatcttgtttcgtttatatctgtaaagtattttgatgatggaaaaatactcgtcggaagatggaaaaacaaggataacccatacaattctattttgtttagaaatgaatacggacaactgcaggctttgaaaaaagaaaacaaggaataacggttttaactgagaaccacggcggaggtgctaaggttcccggataaaataacactacggcagagaggaggcgaaaaggatgccaaacacaaaaggaaaatgggcaactcctgaggtagaagataataaaatagcggcagatattagagccgcggtcaataatgccatggggagaaaaccatataaccacaatgacacggaagcaatcaaagaaagaatactaacctattttgatgagtgcgcgaagagcggaaagcctccgagaatagagggacttacaaatgcgctcgatgtctcccgtatgactcttttaaactggcagaaagagggcggagagcgtggggaactgataagaagagcaaaaggcgttgtgagtgatttgttagagacgtggagcatggagggagaaatcccgagtgttcactggatgtttatggcaaaaacggcattcggttatattgaaaataacagaaccatattcgcaatagaaaatacatccccgattactgatacaggagtaccaagcgtacaagaaattgaaagacgtttgataaatgcggaaccggtgggatgttctgacgatgatttaataaagttattagagacggaagaaagcccaatttcacacgaaactttacacgataaaaaagagaggtaaaaaatatgttaagcagatcattagagaaaacaacgaaagattttattattgcaatcaaccaggcagcaaaggcacaggcggagcagatcgccgaaataagatcacagacaatttacacggaagaacacaagaacgagcaggaaagcaaagtcagagcggcaacggcggcagctatgcagatggttagagacacggcgcgggattcgatcatgtccgcttttacgaatgcacgtgccacggttgaaaattcagtgtcagagggcgcacatgataccactttcgaggaaatcaagaacgcagcagaggcaaccggcggagattttaccgagtttgaaataggtgtattgcttgaaaagtgcgccggtcattactgggcgatgaaattattgtcacgattgaccagagacaacaccaacgccgccgcaattctcaaagagcggtttgagatgccagacccgaactattatttgactttgttcgatgatgaagagggctatttacttggttttatacagatatacaaggacgatcaggccgcccctatggatatcgcaaggagtgacgtaaacggcgagatgcttatatctggggaccacttccagaggctgcacgaacggttagagattaacccggcttatttaaccgatgatgattttcaggccccagtattacgctcctttgaacgtagaacacttagatcatccggcattgtgttagatgtgaatgacacagaaagccgaaagagagtaaaagcagcggcgagacagggtggagctgtcaaaaattgtttaatgcgtaccgtgtggaaagcaactattgacgaagaaataaagataatgtggcaggaagcacaggacaacgcacaaataaaatacggatccgcgggggcaagtgcttttaaggcagtggggagcagatactaatataccactgtgagtgcgtgaaatggttctattttcgattttaatgcttttaatggtaaaatacacgataaaacacaaagagaaccttaaaatcgaaattagaactttacagagggtaaagaaaaacacccggttattattctgccgggtgttagttctccgaatgatttgaaacatattcacgtaatacgatatttacaagattattaaatgatcgtgattgtgaagatgcgattttttcgagttcttttttcaaatcgtcagggattctaatgctcgttggtttcacgctgtttgtgttttcactcatgttagtacctccataacggaagaataacataaaaaagcaataaatacaagtgaaaccatattgactacaaaaacaaatgatgctataatgactacatagtagttacaataactacagaaaatacagaaaggagacaaaaacaatgtatattcaagatccaacacttgcaagtgcattctgtgaagctgaaaaagagtataccgaacaggtagaaaacgaaatactggcacggtacaaagaactgcaggaatgcggcttttcagagaacgaagcacttgaaagaacgaaaggagcagaaggagagcgttacaagaggtttttaaaaaattttgtatgggattatcaacgccgatacagagaagaaaacggcagaacctacagcgcagatcacggaaaaagaacggtttttaatgctgatgaaagaaacgagttgcaaaaggaatacaaagaatatgtgacaaaacttttacagggttaaaaaataaggttccccacgcaccgaccaaagcaccgggaaaccttaacaaaataattctcgatgatgaaaccaccactattttattttattgtgcgtgtgcttccttgtcaaggaaaagaaaaggaggaaagcaacgtgtcaaagattattgcagaattgcaaatgtgtaatggaatgcaaccggagatagaaccgggggatattctaataattgacgcagatagcgaaagcgtgaaagatggcgatattgctttgttactgcttgatggaaatagaaccgtccgcagattaaaacatattgatggcggcgtgtggttgatcccatccaataacgcttttgcagatgaatttattgcaacggaagaaatgggaagagtttgcatattgggaaaagttacggagcgccgcagaaaatactagaatattaaccccatggacagcccacccggaaagattcgatgaatgctcgactggacacaaaaaacatacataccggtagggtaataccatgatagttttaacgattacaccaagaaaaaagagaatcagagacttttttataaagcgagagccacagcggcaatttttcaattatgaatttcctaaggaggtaaaggctaccaatgagccaactaataggaatgcatgaggcctacaggattgcaagaaacagcggatatattaaagaccaggctgtgagctatgcaaccatggctgcaatcgtggcggacgcatacaaaaaagggtacgagaaagcagaggcagacaaaaagcctcgtagttgaagaaaggggcggcgcgtcttttggcgtgttgccctttttttgcagaaaggcggttttgtatatggtaaaaggagcgcagaccatagcacaatataaaattatgcgatggatagacgaacactttacagacgttgaaataaagccacagaaagccgatagcgtgaaaataacggatagtgtgggcggatgtatgataattacaataaacgccacaggggacgttataaacgcactcagcggcgaaatattagacagagagggtgcaatggtatgagtgagaagagaaaagaccacaaggggcgtatattaaagactggggaatattgggatcctaaggggcgtcggtatatgtttcgcaagatggtagacggcgaaagggtaactattacagatgatgacctaatagagcttagaaaaaaggaaaatgaactactacaccagatagacagagggcgcaggatcagcagtaaaagcgcaaaaacgactttaaacgaatattttgataactggctagagctatacgctaaaagtggaagaaaagccaccacatgcaccaattacaagagttattataatacctatatacgggagaccatcggcaagaaaccaataacaaaggtatcaaaagcagacatacagaaaattataaatgatatggtaagggacggaaaaaagcactctacacttgcaaatctcaaaagctgtttaaatatcgtttgtgattgtgctgttgatgatgatattatagtaaagaatccggctaaaaatatacagttaccacagacagaaagcgaaaagcgggagccggtgccggaggaacatataaaaatctttttggagtatgtgcgaaatagtgacagatattcatatagttacccggcgtttttggttctgtttaatactggtatgagaatcggagaacttgcggcgttgacttgggaggacgtggacaccaaagccggggagattcacataaataaatcattgaaccggtacagggaaaaggattacggctttactctggcagtaggcagcccaaaaagtaaaacatcagtccgcacgattgcaatgaatgacacagtaaaacttgccctcctgcgtttgaagatgcagagcacaagagaaaccccaaccctcccacgcgtggacgattcaggcaacataaaaggagaggtaaagggctttgtatttctcaataataacgggaatgtatggagcgagccgccttttagggagcttatagcacgtattacaaagcgttacaataaagaggcggagaagatgggaaaggaaaaaatagaagtgtggaaaccacaccagagccgccacagctacacaagcctcgcctattctgtcggcgcagatatgaaagcagttagccatatgttaggacacgcaagcatcaatacaacacttgatgtatacgcagaacttagcgaagagaagaaaaaggagcaggaggcagttataaaagcggttcggatctcgtgacagtttgtgacaaaatttgcgacactagcggtcaatgtgataactattagatgcaatcagatgaatgttgtttttataaggaagtattgaaaataaagcagatgcaacgagatacaaacacacgaacatatgtgtgacaagaaaaaatacttgacaccttgttttctttatggtaaagtatccaaggtgattgatgtggaagaaaagttacaacaggcttatttatatgatttttatggcgagttactgaatgaacatcagcgccggatctatgaggacttcgtgttcaatgatctttctctcggtgagattgccggggaggaggggattaccagacagggcgtggctgatatgatcaaacgctgcggaaagaagctttcggattatgaaaagaaacttcatctggtagagaagttcttatctgtgaagcaggatgtggaggaaattcacagactggcagaacagtttcatcaaacaaaagatgaacagatcgtagaacagatcgcaacgatttcaaatcagattttggaggagctgtagtatggcatttgacagtctttctgaaaaattgcagaatgtatttaagaatcttcgcagcaagggcagactgacagaggacgatgtcaagacagcactgaaagaagtcaagatggcactgcttgaggcagatgtaaatttccgtgtggtcaagaagtttgtaaaagatgtgcaggaacgggcaatcggacaggatgtgatgagcggtctcaatccgggacagatggtcatcaagatcgtaaacgaagagatggttaagctcatgggctccgagacaaccgagattgcgttccggccgggaaaagaactgaccgtcattatgatggtaggtctgcagggtgccggtaaaacaactaccacggcaaagatcgcaggcaaattaaagaccaaagggaaaaagacactgctggcagcctgtgatgtgtatcgtccggctgcaatcgaacagttgcagatcaatggagaaaagcagggcgtggaagtattttccatgggaaataaaaacaaacctgcggatatcgccaaagcggccgtggaacatgcaaagaaagaagactgcaatgttctgatcattgatacggcaggtcgtctgcatgtcgatgaagagatgatggatgagcttgtggagatcaaagaagcggtggatgtattccagaccattctcgttgttgatgcaatgaccggtcaggatgcggtaaatgttgcttcgacatttaatgacaagataggaatcgatggtgttgttctgacaaagctcgatggagatacccggggcggtgcagctctttccatccgcgcagtgacaggaaaaccgattctgtatgcaggtatgggtgagaaactttcggatctggaacagttttatccggatcgtatggcatcccgaatccttggtatgggtgatgtgcttaccatgattgagaaagcacaggagaatctcgacgaggaaaaagccaaagaacttgagcagaagatgcgcaagaatgaatttgactttgaaatgtatttagagtctatgagtcagatgaaaaagatgggcggtttgtccagtctgatgggcatgatgccgggacttggactcggcggtggaaagatgccggagattgatacggacgaagcggagaaaaacatgcggagaatagaggcaattattcattccatgacaccgcaggaacgtaaaaatccgaatctgctcaatccaagcagaaagaaccgcattgcaagaggtgcgggtgtacaggtggcagaagtcaaccgtctggtcaagcagtttgagcagacaaagaaaatgatgaaacagatgcccggcatgatgggcggcaaacgtggtaaaagaggaatgttcaaaggacttcccttttaaataaaaaacaaaacctatgaggaggtgaaatcatggcagtaaagatcagattaagaagaatgggacagaagaaggctcctttctatagaatcgtagttgcagattcccgctcaccaagagacggaagatgcatcgaagagatcggaacatatgatccaacaaaggatcctagcgagtatcacgtagatgctgagctggctaagaagtggttatctacaggcgcacagccaacagagaccgttaacagaatcttcaaggcagctggtatcgagaaataattccgaagggtggatgtaattaatgaaagaattagttgaagtaattgcaaagtcactcgttgatttcccggatgaagttgttgtgacggagtctgagaatgaaaaaggaactctgctggaacttagggttgcacagtccgatatgggcaaagtaatcggaaagcaggggcgcattgcgaaagcaatccgtgcggttgtgaaagcagcggcatccaaagaagacaaaaaagttattgtggaaatcatgcaataacataacggtaggatataccgcattaagcaccccgcagctgcgaggtgcttgtttttctatgaaacaaattcgtgagagaatctgcacaataggagattttatggaagatttatttcaggtgggagtgattacggctcctcacggggtacgtggagaggtgaaagtgtttcctaccacggatgataatgcccggtttaaaaatttgaaaacagtcctccttgatcagggtcggggaaccagagaacttgaaatcgaaggtgttaagttctttaaaaatatggtgatcctgaaattcaaggggatagatgatagaaatgacgtggagagaatgcggcaggcaaagctgcttgttaccagggaaaatgcagtggaattaggaaaagacgagtattttattgcagatctgatcggaatacaggtggtttcggatgaaggagaagaacttggaacaatctccgatgtattgcagaccggtgccaatgatgtctatgttgtgagtaaagacggcgcaaaagatctgctcattccggcaatccatgcgtgtatccagaacgtggatgtggctgcgggacagatggaagtacatctgctgccgggactgcgttaaacggagggtggacaatgaagtttcatgttttgacactttttccggatatggtgatgcaggggcttatgacaagcatcacagggagagccgtacaacagaaaaaaatagatattgatgcggtgaatattcgtgattatacgcaggataagcatggcagggtggatgattatccttacggcggcggtgcagggatgctcatgcaggcacagccggtatatgatgcatgtcagagtgttatggaaaagataccgcagaataagaaaaagcgggtgatttatgtaaccccgcagggaattccttttacacaggcaaaagcacgggaactggcggcacaggatgagctgcttttgttatgcgggcattacgagggcattgatgagcgcgtgcttgaggaagtggtcacagattacatttccatcggtgattatgtactgacgggcggcgagctggcagccatggtgattgtcgatgcagtggcacgcctggttccgggagtgcttggaaatgaacagtcggccctgaccgaatctttccacggagagcttttggaacatccgcaatattccagaccggatgtgtggcacgggaaaaaggtgccggaggtgctgctttccggaaaccagaaacacatagatgcatggaaaaaggaacagtccatcctgcgtacaaaggaacgcaggccggatctgtatgcccgctatgtgcggctgcaggaatgcagacaactgcttatgaaacagaaactgttgcacatcgatatgattgaactgatcaatcgtggacgcgcacaactgttgtatttcgggcagggacagatattgctcaaagatatggaatacgagatctattttcatgcatgtgttgatccgtcaagacttccggatatccgtacatggacgcttccggttgaaaaaataccgctggcggttttgcatcaggaggaaatgattccttattttcaaaagagatacggacttaatcaggagtgcgaatgttatcaggctgtgtacaccagacatgaaaagcttccggtgcgcgggttataccggccggatctgacgcgtgaggatggattgtcgatgcgcagattacaacgagaagattttccacaggtggtttccttttatcacggctgctgtgatgaggactacctgcggtcgaggatacaggatggtatgcttgtgggggctttttatgacgaaaagcttgccggatttatcgggcagcattgtgagggaagtatcggaatgcttatggtagcaccaaaattccagcgcagatacattgccatgacgctcgaaacgtatgcagcaaactgtatgctcgaacagggaaaaattccgtttgcacagattatcacggacaacgaaaaatccatgagattgcaggaaaaagagggattttgcctgtcgcatgacaaaattttctggatgtgcgaaaaatgatgaaaaaggacttgatttttcggaatgagtatgctagagtttataattgttgcggtgtaattatccagtaatattacggaacggatagttacaaatgtgaatagaagtgacggtcctctggcaccgatagatggagtttaagaacgtcaaaataatcaggaggtcacaaaatgaacgcgagtgaaattatcaagaacattgaggcagagcagttaaaggctgaagcaccacagttttccgtaggtgatactgtaaaggtatacggaaagatcaaagagggaaaccgtgagcgtattcaggtattcgaaggaactgttattaagaagcagggtggaagcaaccgtaccactttcactgtaagaaagatttcaaacggtgtaggtgttgagaagacatggcctttacattctccaaacgttgagaaggtagagatcgttcgtaaaggtaaagtacgtcgtgcaaaactttactacttaagagaccgtgtcggcaaagctgcaaaggtaaaagagttagtaaaataatttgcttcatggaagggatgccacagaatgcggcatcccttttttctaacttgaattaaagaggtggaaaagtgaaaagaagaagcggactgaatttcagcagaagaagaaaaaagtttaatgtgcccctgtttaaagaaattatgacctgggtattagaatgtgccattgtaattgccattgcatatgcactggtcagttcttttggttttcggacgacagttgtgggaaatgccatgcaggataccttacagagcgaggaacagatttttgtcaatcgctttgtctatatggtacgcgcgccaaagcagggcgatgtcgtcgtttttttgccgaatggaaatgaaaaatcccattattatgtccggagggtaattgcctgtccgggggatacggtacagatcaaaaatgggaaagtatatattaatggagaactttacaaggaagatattgtttctgcttccatcgaagatcccggtgtggcagcagatgaagtgaaacttggggatgacgaatattttgttctcggggataatcgaaacagcagtgaggacagccgtatggcaaatatcggaaatgtgaaaaaagattatataattggaaaagcgtggttccattttaagggatttggaaagatgggactgatcgattaagcgggctgatttaggaaatgaggaaaaagagatgaattttcaatggtatcccggtcatatgaccaaagcaaaacgacagatgcaggaagacatcaaactgatagatctggtgatcgaactggtagatgcccggattccgctcagcagcagaaatccggatattgacgaacttgggaaaaacaaatatcgtctgattttaatgaataaagcggacttagcggactgcaaggcaaccgagcagtggtctgcttttttcaaaaaaaaaggatattatgtggtaagccttgacgcgcgaagcaaaaacggaatgaaatccattaccgatattattatggaagcctgtaaggaaaaaatggagagggaccgtaagcgcggaatcaaaaaccggccggtccgtgccatggttgttggaattccaaatgtcggaaaatccacatttatcaattcgtatgcgggaaaagcgtgtgcaaagaccggaaacaagccgggtgtaacgaagggaaaacagtggatacgtctgagcaaaagtgtagagcttttggatactccgggaattctctggccgaaatttgaggatcagaaagttggacttcgtctggcgctgatcggttccatccgggatgagatcttaaatacggatgaacttgcggtagagctgatccgtttcctgaaaacacagtatccgggaatcctgacagaacgttatgaagtcgaagaaacacaaaaggagaccgaacttttatgcgggattgcagaaaacaggaaatgtatcacgaaaggcggggaacttgattacagcaaagcggcagcacttctgattgacgaattccggagcggaaaactcggaaaagttacgctggagtggccaaaggagcaggaaaatggctgaaaaaattgatgcgattaaagaggaactgacagtaacaccgacggaagcattggaggcgtttgtggaaaaatatgcgtcggattcccgcaccggtgtgcagaaactggtggataccgcaaaaaaacgcatggataagctacagaaggaaatgatccgcacggaaaatttaaagaaatatgaaaaagagtacgatacatatacatatatctgtgggatcgatgaggtaggacggggaccgcttgcgggaccggtcgtggcaggagctgtgattctgccgaaggattgtgatatattatatattaatgattccaaaaaactttcagcggcaaaaagagaagaactgtatgatatcatcatggagcaggcagtggtaaccggacttggcacgatcggtccggacaggattgatgagatcaatattctgcaggcaacgtatgaggcaatgcggcaggcgattgcacagttatctccgcagccggatctgctgcttaatgatgcagtgacgattccgaaagtgacaattccgcaggtaccgattatcaagggagatgcaaagagcatttccatcggtgcggcatcgatcattgccaaggtgaccagggaccggatgatggtatactatgattcgatttatccggagtatggttttgcttccaataaaggatatggaagcgcggaacatattgcagcactcaaaaagtatggaccgacaccgattcacagaagaacctttattaagaattttgtatcataagataattattcaaaatcacaaagggggctgttcggatgcagatttcagatttggtaaaacagtatcatcaggcgatctcatcaggtgcggagacgctgaccgggacgaaaggtgtggaaaatcttgtggcctctctgcggtctctgacaaaaggaaatatttttgaggggacggtcacttccgttaaaaatggccgcgtgacgctttctctttccggagggcagcaggtgatggcacggctggacggaaagatttcccttatggaaggggaatccatgtttttccaggtaaagtccaacgatggcacgcagattgccattcggccgtttgcaattgacggggcaggcgcaaattatacgctgatgcaggcgctttccgcagcgggactttccgcacagccggagtatttgtccatggttgaccggatgatggaagaacagatgccgattgaccgggagagtctgcagcagatggcacggctggtcaatgcaaatccgcggattgatgtacagacgctggtacagatgcaaaagcttggaataccgattactgtagaaaatgcctcccagtttgaaaattatatgaatgacagtcaggcgattacacgggaactggatgcactgattgagcagtttccacagagtctgaccggaacagaaggcgcaccagtaaagacagagaccatgcgtcagcttggaaatgagttgttgcagattctgacagacgggctggaagaagtaccgcagcagatacaaagtccggaaccggatatggcatacaacctggatggtctgaattatgaaagcgtgcagacagataccgcagaaacgcagatgcagacggaagctgcaccggagactgccacggaaaccgtgcaggaaaatccggaaattttgtcgcagcaggaaggtcaggctgtagcggaggagaaaggagtggccggacagcaggaaaccgaaactatggaaactgtttccggaaaaacaacttataccgggcagatgtcgcagactccacatacactgggagctgtactttcacaggaacagctgcagcatttaaaccggatgatcggagatattctcggaaagccgcagagtgcatataacgcaaatagcggtacggtagaagtgttaaaggatctgcagcagctgtgcaaagatccgttgccgttggaacgggaacatctcggaaagctgttttcttccagggaattccaggcacttgtccgggatacggcagaacagcagtggatggcgaaaccaggggatctcaaagagggcgattatgtcgggaggctgtatgaacgtctgaacagtcagatggaaaaaattgagtcagcactcaaaaatgcgggacaggagcataccgctttctcacagatggcgggagagatccacagcaatgtagaatttatgaatcaggtgaaccagatgtacacatacgcacagattccactcaaaatgtcggggcagcatgcaagcggcgaactgtttgtgtataccaacaaaaaggcactggcgcagggagaaaaggatctgactgcttttttgcatctggatctggatcatctggggagtacggatgtttcggtccggatgagaggacgtgaagtaagtacgcgtttttatctggacaatgacactgcatatgcattgctggaaaaaaattatccggtgctggaagcgaggctggaaaaaaagggatatcactgtaagatcgacgtggtaaatgaagaaaaacatgtaaattttgtggacgattttctgaagatggatcagccggcggcgacacagctgcaccggtattcctttgatatgagggcataaaatggaaaataataattttaaaccctttccttttgagcagttaaaacaaaagaaagaaccggagaaaacggcagtggcgattgcctatgagccgggcgaaaaagcaccaaagatactggcaaccggaaaggggcaggtagccgaaaaaattattgaaaaagcaaaagagagtcaggttccgacttacaaagacaataaacttgcgtctaccctttccaaattgcagatcggggacatgattccgccggagctgtatgaggtggttgcggagattcttgtttttgtggatgatatggatcgtatgaaggcaaagattgatcaggcaggggttaaataaaatttgaataaacgtacaattggaacagaatatgagaccatggcagcccggtatttgtgcacacatgattacacaattcttgcacgcaattaccggacaccatttggagaggtggatcttattgcacaaaaggacggggtacttgtatacgttgaagtaaaataccggagcagcaatgattacggagatccgttagaggcggtagacaggagaaagcagcgccagatctgtaaggttgcaaattatcattatgcaggatatgcagcagggcaggagatggactgccgttttgatgtgattggaatttatggggacggaagtatccggcacatcccaaatgcattttattttcagaggtgacagacatggacagagaagattttcagtggaaaaataaagagcatatactggaactggaacagtttcagggcaaaaagggacaggggcttccgcttttgtattttccccttcttttggcacatacgggcgtaaagaactgttttaccaccagagagggtggatgcagcaccggaatgttccggagtctgaatctgagttttacacgtggagatgatccacaggcagtgacggaaaactaccgcagggtggcagaggcaatgggaggaacgctttcggatattgtctgttcggatcagacccatacgacgaatgtccggcgggtggatagaagctgcgggggctatggtgtgacaaaggagcggccttacacggatgtggacgggctggtgacggatgaaccgggactgattctggcaactttttacgctgactgtgtaccgctttattttgtagatcccatacaccatgcgatcggactttcccattccgggtggagaggaacggtcggacgcatggggcagcataccatcgaggtgatgcgcagggaatttcatagtgaccccggagaaattcttgccgccgttggaccgtccatctgtcaggactgttatgaagtaagtgaagatgtggcatctgcctttgcaaaagagttttccggtcatgagtgtgagatcctgatcgaaaagggcggtggaaaatatcagctggatctgtggaagagtaatgagattgtgctgcgggatgcaggaatccttccggaacatctggcggtaacgaatctttgtacctgctgtaatccgaatctgttgttttcccatagggcaagccatggaaaacgcggaaatctgggagcatttttaaaacttgtgtaacaaattaagaaatccttaagaatgtatttcaaagatgttaaattactcggggaagatttatggtacactgactgtattgaggaaagataggaggatgctctttgatgcagccagattgcagagatatcaaaccggtctatgagcagatcacggacgggattcgaaaaatgatcataacgcatgcgataccggagggagaaaaacttccgtcagtgagggaactggcttcaaaatttgccgtaaatcccaatgctgtaaggaaagcttatcaggagctggaagaggaagggtatgtctgtgactgggaaggcgaacggatggcggcatcggaaaagcagattgcggaactgatccgcaaagagctgctgcaggagttcgacacggtggtaatcagactgcagaatatgtcggtagggacagaggaattgacaggacgtatgtgggaactggcaggaggaagcaaagactttgattgaagtaaataatctgataaagaaatttggggatttccgtgcgctcgacggggtaaatatgcatgtggagtctggaaacatatatgggcttgtgggaccaaatggtgccggaaaatcaaccctgattcgtcatctgacaggtgtataccggcaggatgccggagaaatttttattgacggggctccggtatatgaaaataaacaggtaaaggctcaaatggcttatataccggatgagccgttttattttttacaggcggatacactggaaatgatgcgttatttccggggaatgtacgagtcctttgacgaaaagatgttttatcgcctgcaggagtttttcccgggaattgatatgaaacgcaatatccgcagactgtccaggggaatgcaaaaacaggttgcattctggctggcactctgctgcagaccgaaacttctgattctggatgaaccgctggatggccttgatccggttatgcggaaacagatctggacgatcctgatgtccgaggttgcagagcgcaggacgaccgtactggtttcttcccataatctgcgcgaactggaggatgtctgtgatcatgtgggcattatgaatcacggaaaggttataattgagcgttccctgtttgatttacatggaaacatcagtaaaatccaggtggcatgccagaccggtatgccgaaactcccaaaagaatttgaggtattgcatatgtcaaattccgggcgtgtatatacaatgattgtcaagggaaatcccagggaggttgcggcagccatccagacagagggagaccatctggctattgtggacattctgccgcttacactggaagaaatttttatttatgaaatgggaggtttgggctatgaagtcaaagacatccttttttaaccgtacggtttttaaaaaaaatgtgaccctgtactggccgatctgggtatgctatctgttatatgggatggtaaaagtgccggggcagctgtggtcgcgtctgcagcaacagacggacatgactgcttatgccagggattatgcattgtacaacagtctgcgtctggaagtggatgtggccgcaattgcaattatggcagtcgtctgtgggatggctttgtttggctatctgtttacccagaagaatgcgtatatgatccatgcactgccggttacaaggggggaactgtatgtgacgaatatgatcagtggcctttgttttctattgattccgcaggcactggtttttctggtaacggtggttctttgtcttttgaaaggcattgcgagtgtgcagtttctgggattgtggtttttaagtgttatgggaattgcttttttcctttatgcaacggtgtgtttttgtgtcatgtttaccggacagctgtttgcacttccggtgtactttctggcagttaattatgtggcatttgcattttccagcggtgcacgttatgtcatcggatatctgggatatggacttggcatgaatactgtgccggaatttttaattttgcggattctttccccgatgaattatctgtacaacaatgtgcggtttgtattccggcaatcctataaccaggaaacggatctgatgtcgggggtgttgtcctaccggggactgcgggtacttgcggcctatgtggctgcagcagttgtcatttatctgattgcttattactgttataaaaaacgcaggattgaaagtgcaggggatctgatttcttttaactgggtaaaaccattgttccgctggggcgtgggaaccggagtcggttattttgcaggcgtcctgatggcagaatttttagattccgtgcatctgcatgtaaaaaaaccaatgttgcttgttcttgtggtggcatttggttttgtcagtttttttattgcacagatgtttgtggaaaaaggatttcgcgtattttgccgccggagattctgtgagagcgggttatttgtgctgtttgtgctgggcagtttctggggatgctcaaaaaatgccacctatctggaacagtatgtcccggatgcagatcaggtaagccgggtggaagtttctcttgattatccggtagaatataaaggggacagcgttcgtgtggcacgtcaggcacagaaagaaattttaagtcatgcggaaatttacagggaaaataaaacggatgacagtacgcagatcattttttattactatctgaaaaacggaaaaacgctctcccgcacatatgaaattgtcggggggaatgaaacgctttcagaactgttgtttaaagaagaaaataaagtggatcattttatggaatatctctttggaacggattctgacaaaatttcaaagtttagtaccggaacgttgacgttaaatgaatcatcggaaaattataaggattgtgactttgatgcggatactgcaaaaaaactgtatcaggcgatttatgaagacgccgcagatcagaagctgcaaaagtacaatctgacgaatgcactgaaagatccggaagaaacaggggagtactcttctgccagtatcagtctggattattaccatgcatctgcagactggaaaaacgtatatgaccggattgatgattattacggaaatacgggagaatccgtggaaacacccacaacatatggtggatctgcgtatatcagttttggaaaagactgcacccatatcatacagacactgattgactgtggtgtgattaccaacgtatcggacattcagttccagcggccggaagagaaaacatcacagtgatgaaaccagcgggactttacaactttcgctgcttattgtaaaataaagatggcgttttcggacgccatccatttttttgttggaggtaaaaaatgagcagaccagtcgtagccattgtcgggcgtccgaatgtcggaaaatctacgctttttaatacattggcaggagagagaatctccattgtaaaagacactccgggtgtcacaagagaccgcatttatgcggatgtcacatggctgaactataattttacattgattgataccggtggaatcgaaccggacagcggggatgtgatcctttcccagatgcgtgaacaggcagagattgcgattgccacggcagatgtgatcatgtttatcacggatgtgcgtcagggactgcaggatgcggatgcaaaagtagcggatatgctgcgaagatccaaaaagccggtggttctggtggtaaataaagtggacagttttgaaaaatttatgccggatgtgtatgaattttacaatctcggaatcggagaaccgtatccggtttccgcttcttccatgctcggacttggagatatgctggatgaagtggtgaaatatttcccggaaggatcggaaaatcagccggaggatgaaagaccgaaggtagccattatcggaaagccgaatgtcgggaaatcatccctgatcaacaagctggcacaggaagaccgtgtaatcgtatcggatatcgcgggaactaccagagatgccatcgatacagacattaaatacaacggaaaagaatatgtatttattgatacggcggggcttcgccgcaaaaacaagatcaaagaggagattgagcgctacagtattatccgtgcagttaccgctgtggaacgcgcggatgtggtgatcatcgttattgatgccaccgaaggagtaaccgagcaggatgccaagattgccggaattgcacatgacagaggaaaaggtatcatcattgcggttaacaaatgggatgccatcgaaaaggataacaacacggtgaagaaacataccgagaaaatccgtcagatcttaagctttatgccgtatgcagagattttgtttatttctgcaaagtccggtcagcgtctgaataagatttttgaaatgatcgatgttgtcattgagaacaacagtatgcgtgttgcaacgggtgtcttaaacgaaatcgtgacggaagcagttgccatgcagcagccaccgaccgataaaggaaaaagactcaagatttattatgtaacacaggttgcggtaaaaccgccaacgtttgttgtatttgtcaatgacaaaaatctgatgcatttttcgtacaccagatatctggagaaccgtatccgcgatacgtttgggttccgcggtacagctctcaaattcattacgagggagcgaaaggaagactagttatgatgatcgttgcaagaatcattgcattactgatcggatatggattcggtctgtttcagacgggatatctgtatggaaaaagtaagggaattgatatccgtcagcagggaagcggaaatgcaggcacgacaaattctttgcgggtgcttggatggaaagccggcattattacatttgccggtgatcttctgaaagcagtatttgccgtacttcttgtaaaactgatttttcacggaacgtatggggctgatacaaaggtgctggaactgtatgccgggtttggaaccgtcttaggacataattttccgtgctatctgcagttccgcggcggaaagggaattgcctgtacgacaggcgtcatccttgccgtctgtcctccggcagtaatctgctgtgccgttggattcctgattattgtgggaattacccggtatgtttcggtgggttccatatttctggtatctgcctatctggtacaggcgattattttcggacagattggctggttaaaaatcagcggagccagccggatcgagttttacatactgagtgcatgttttaccggcatggcgatttggagacaccgtgcgaatattgtccgtctgatgaatggaacagagaacaaattcggaacgaaaaaaggagataaatgatatggcaaaggtaggagtgatcggagctggcagctggggcattgcgctggcaaagcttcttcgtaccaatggaaatgaagtaacggtatggtcgatcgtggaagaggaagttgccatgctccgcagagagcatgagcatatcgataaacttccgggagtgaagcttccggaggatgtcctgtttacaacagatttaaaagaagcaatcgttggaaaggagttcctgattctggcggtaccgtctgtatttacaagaagcaccgcaaaaagtatggcaggatatgtgacagaaggacagatcattgtctgcgtggcaaagggaattgaagaagataccctaatgaccatttccgatgtgacagagcaggagattccatgtgcggatgttgctgtcatgtgcgggccgtcccacgcggaagaggttggaatcggacttccgacaaccgttgtggcaggagcaaaaacagaaagcactgcaaaaaaaatccaggatctgtttatgaatgaagtgttccgtgtttataccagcccggacatgcttggcatggaactgggcggatcattaaaaaatgtgattgcacttgctgccggaatggcggacggactcggatacggggataacaccaaagcggccttgattacccgcggcattgcagagattgcgggacttgccgtaaagatgggggcaaaagtggagacgctctgcggactgaccggtatcggagacctgattgtcacctgtgagagccgtcacagcagaaaccgcaaggcgggtatgctgatcggacaggggtataccatgaagcaggctaccgacgaagtgaaaatggtcgtagagggaatttattcggccaaggcagcacttgctctggcaaaaaagtatgatgtggagcttccgattatagaagaagtgaataaagtactgttcgatgacaaaccggcaaaggaaggtgtaaaggatctgatggtccgcgaaaaacgtgtggagcatctgaatctgaagtgggaaaactgatatgcagaaaatcaagattaaatattttacagacaaaatcgaaccgctggattacattgaaggaaaatccgattggattgatatgcgggcttcggaagaagtaactttaaaagcgggagagtttgcactgatcccgcttggcgtggcaatggaacttccaaagggatatgaggcacatcttgtgccgcgcagttccacatttaaaaactggggaattatccagacaaacagtgttggaattgtagatggttcctattgcggggacaacgatatgtggcggatgccggtttatgcaaccagggataccgtgatccacgtaaatgaccgcattgcacagtttcgaatcgtggaaaaccagccagagattgtatttgaaaaggtggaacatctgacggggaaagatcgcggtggctttggcagtaccggattatcataacaataacagcaacaggagaaggaggattatactatggaagatcgtatgatgaaattttattcaaaagaaagcaacatgctggcgctgcatgccatgcacggacattttgcaacgagtcattcccacattaattattatgtggatgtgacaagtatcaagacacgtgtggcggaagcaaaacaggcggcacatgtactgtattcgagaattccaaagacaaaatacgtggataccattgtgtgtatggatggaacggaagtggtcggtacctttctgacggaggagatccagcgggacggaattatgggcaccacaaaccagcatgagacggtgtatgtgatttcgccggagattaacagcaataaccagatgctgtttagggataacaataaagctgccatcaacggaaaacatgttgtgcttcttttagcaactacgacaaccggcgagaccatccgcagagcactcgagtgtatccagtattacggaggagagatcgagtgggtggcttctttattcggaacgatcaattcggtagacggcgtagaagtcgagacactttttgatgaaaatgatgtcaccggatatgcggcatatccggttgcagactgtccgctctgccggcagggacaaaagattgaggcgatggttaacggttttggatattcaaaactgtaatttttgggggcattgtttacaacaatgtcccctttcgttatttcgccaagaaaccatgtaaatatttggacggattgacggtggtaatttcgggcagattccgttatcatacacttgtcaggaagttcaaagaaacttcaccaaagaaaaataacgaaaagcaaaaatcaggaggtttttcaaatggcaagtttatcattaaagaacgtttgcaaagtatatccaaacggatttgaggcagtaaaagatttcaatctggatgttgcagataaagagtttatcatcttcgtaggaccatctggatgtggtaaatctacaacacttcgtatgatcgcaggtcttgaggagatttcttccggtgatctgatcatcgacggaaaggtaatgaacgatgtagagccaaaggatcgtgatatcgcaatggtattccagaactacgctctgtatccacatatgacagtatttgataacatggcattcggtcttaagttaagaaaagttccgaaggatgagatcaaagcaaaggttgaggaagcagcaagaatccttgatctggagaagttactggatcgtaagccgaaggctctttccggtggacagagacagcgtgttgccatgggtcgtgcaatcgttcgtaatcctaaggtattccttatggatgagcctttatccaacctggatgcaaaacttcgtgtacagatgagatctgagatcgcttctttacataacagattaggtgctacgatcatctatgtaacacatgatcagacagaggctatgacacttggaaccagaatcgttgtattaaaagatggtgtaatcatgcaggttgattctccacagaaattatacaatgagccaaataacttattcgtagccggattcatcggatctccacagatgaacttcatcgatgctaagtgcaccattcagggagataaagctacattaacattcggtgattactctgtggttcttccggattacaaggcaaagaagcttgaagagggcggatacaacggaaagacagttgtattaggtatcagaccagaggatatctctgatgatcctgaaatgatccagaagaatggtgactgtgtcatcgagtctgatgtaacaggatacgagttacttggtgcagaagtattactgtactactctgtagccggtgcaaacatgacagcaagagttgattctgatacacctgcccgttatggtgatcatatcaagcttgcatttgatccgcataagattcatgtattcgataaggaaacagaattgacaattaccaactagtccgttaaaattatatagttgtaaatcttgaacccgggtgttagtatttacacccgggttctttcgaacgtaaataataggagagtatatgctttcaaatcagaaattacagaattcattaaacgaaattaaagagatcagccacatggatacggcattgtttactgcaaaggggaagctggtagcacatacggaggagatgccgttgccggaggcattagaacagcaggtggtcgttgatttcgcagaatcgcttgctgaaaaacagacgtatcaggattatcatctgtataaagtgatggtagaaggtgaaacggaatatattttagtctgtctggtgaaagaagagtcatttcttgtatgcgcacagatggcagtctgccagatccggaatctggttatgagttttgcagagcagttcgaccgcaataattttatgcagaatatcattcttggtaatatgctgattgtggatatttacggaaaagcaaaaaagcaccacattcaggaagtaccgcgggtagtttttgtgattgataccggaagtaaaaataacgatatggcgatggaactggtaaaaaatcttgcagatatccgttcgaaggactttgtgacctgcgtggatcagcacagtatcgttctgatcaaagatgtttcccatataaaagaagaggagatggaggaacgtctgtcaaaaattgcgggaagccttgcagataatttacatatggaagcaatgattcgtgtgcgtgtcggttatggaaacgttgtgacacagcttccggaaattgcggaatcttatcaggaagcgcggatggcactggaagttggtcgtgttttttatgcaaagtatgacacaatttcttacggaaagcttggcatcgggcgtctgatttaccagcttccgatgagtttatgtaatatgtttatcaaagaggtattcggtgagaaaattccggacatcttagatgatgaggaagcaatgtctactatcaataaattttttgagaataatctgaatatatcagagacggcaagacagctgtatgtgcaccgcaatactctggtatatcgtctggaacgtatcgagaaagcaatcggactggatatccgtacgtttgacgatgcgatgacttttcggattgcagtgatggtgattgctcacatgagagatcaaatgtaatttagcaggatagtaaggagatagaggaacatgtcaggatatgatgcaagcagtatatcggtactggaggggcttgaagcggtccggaaacgtccgggaatgtatatcggaagtacaacgaccaaaggactcaaccacctgatttatgagattgtcgacaattccgtggatgagcatctggcaggtgcctgtgataaaatatgggtgacccttgaggcagatggctcctgtacggtggaagataacggacgtggtattccggtcggcatgcatgcaaagggagtatcggctgcccgcgttgtattttctacactgcacgcaggaggaaaatttgacaacaatgcgtacaagacgagtggaggactgcatggtgtcggatcttcggtagtcaatgcactttccacctatatggatgtggaaatcagccagggcggatatgtgtatcatgaccgctatgcacagggacatccggtggtagaacttgaagacggacttcttccaaagatcgggaagacaaagaagaccggaacgaagatcaattttcttccagatccagaaatttttgagaagaccagattccgagaagatgatgttaagagccggatgcatgagaccgcttatctgaacccgaaactgacgatcatatatgaggaccggagaaagccggaagcagagcacattgagtttcatgagccggatggaatcattgggtttgtcaaagatctgaacaataatctcgaagtgctgcatgatgtcatttacttcaaaggggaaagtgaaggcattgaggtggaagcagcattccagtataccagcgagttccatgagaatatcatgggattctgtaataatatttataattcggaaggtggtgcacacctgaccggatttaaaactgcgtttacgacgattatcaattcctatgccagagaacttggcattttaaaagagaaggatgcaaatttcaacggtacagatgtgcgaaacggaatgacagcagtgatttccatcaagcatccggacccgcgttttgaaggacagacgaagacaaaactcgataatcaggatgcaaaccgtgcaactgccaaagtgacaagtgatgaagttccgctgttttttgataaaaatttagaaaccttaaagattgtgattggctgtgcggaaaaggctgcaaaaatccgcaaggcagaggaaaaagcgagaaccaatctgctgaccaagcagaagttttcgtttgattccaatggaaaactgtccaactgtgagagccgggatgcgtcaaagtgtgagatttttatcgtagagggagattctgccggtggttccgccaaaatggcgcgaaaccgtatgtatcaggcgatcatgccgatccgcggaaaaattctgaatgttgaaaaagccagtatcgacaaggtgcttgccaatgcagaaatcaagacaatgatcaacgcattcggctgcggtttttcggaagggtacggaaatgattttgatatcagtaagctgcgctatgacaagattattatcatggcagatgccgatgtcgacggagcccatatttccacgctgcttctgacactgttttaccggtttatgccggaactgatttttgaaggacatgtgtatgtggcgatgccgccattgtacaaagtgattccgtcaaaagggaaagaagagtacctttatgatgatgcggcactggaaaaataccggaaaacacataccggaagttttaccctgcagcgatacaaaggtctcggagagatggatgccgagcagttatgggagactactttaaatccccagacgcgtgtcatgaagcgcgtggagattgaagacggtcgtatggcgtcggatgtaaccgctatgctgatgggcacggatgtgccgccgagaaaggcctttatttatgaacatgcaaacgatgcgatcttggacgtatagatcctgtcaggttttctaggagtgaggaagaaataaaatggaacatagtatcattcgcaccgagtattcggagctgatgcaaaaatcatatattgactatgcgatgagcgttatcattgcccgtgcgctgccggatgtccgtgatggattaaaaccggtgcagcgccgtacactttatgatatgtatgaactgggaatccgatatgacaaaccgtatcgtaagagtgcgcgtattgtcggagataccatgggtaaatatcatccgcatggagattcttcgatctatgatgccctggttgtcatggcacaggatttcaaaaagggactgccgcttgtggacgggcatggaaattttgggtccattgaaggcgatggtgccgctgccatgcgatatacggaggcacgtctgcagaaagtaacgcaggaagcctatctggcagatctggataaaaatgttgtggatttcatgccgaattttgatgaaaccgaaaaagagccggttgttttgccggtaaaggtgccaaatcttctggtcaacggtgcggaaggtatcgctgtcggtatggcaacttccattccgccacataatttcggagaagtgatagacggtgtgattgcctatatgaaaaatccggatattaccactgcggagatgatgcagtatattccgggaccggatttcccgacaggaggaatcattgcaaataaagatgatcttccggcaatttatgagtccggggtcggcaagatcaaaatacgtggaaaaatcgagattgaaaagggcaaaggcggcaaagaccgcatggtaatcacggagattccgtataccatgatcggagccaatatcgggaagtttttaaatgatgtttacggtctggtagaatccaaggcaaccagtgatattaccgatattaccaatcagtcatccaaagagggaattcgtattgttctggaactgaaaaaaggagcagatatcgaggctctggagaatctgctgtacaagaaaaccaagctggaagacacctttggtgtcaatatgcttgcggtagcggatggcagaccggagacgatgggcgtcgtgccgatcatccgtcatcatgtgaaattccagtatgagattgcaaccagaaagtaccagacccttctggcgaaagaacaggacaaaaaagaaatacaggaaggtctgatccgcgcctgcaatgtcattgatctgatcattgagattttacgcggcagccgcaacatcaaagatgcaaaagcctgtctgacagacggaaatacggatcatattacctttaagaatccatcttcaaagatcatggcacagcagctgaactttacggatcgtcaggcacaggccattctggaaatgcgtctgtataaactgatcggtctcgaaattgaagcattgatgaaagaacatgatgagacactggaaaatattgcaaaatatggggatattttagagcatcgttcttccatggcaaaagtaatcatcaaagagctgaccgcgtttaaaaaagcttatggcaaagagcgcaaaaccgtgattgacaatctgaaagaagctgtagttgcagcaaagaagatcgaggagcaggatgttgtctttctgatggaccgcttcggatatgcaaagattgtggatacttctgtctatgagagaaataaagaggcggcaaacgcggaatacaggcatatctttacgtgcaaaaatacggataaaatctgtatctttacggacaagggacagatgcatctgctaaaagtgcttgatcttccatatggaaaattccgggataaaggaacaccgattgacaacctctgcaattatgacagcagggaagagaatgttgtatatctggcaggtcttgaacatgtcagctcgcaccggatgttatttggcacaaagtatgccatgatcaaggttgtggacggcatggaatttgtggttgcaaaaaagacaacagcggcaacaaagctgggagaggaagatgaagtactaacggtatgtccgttagaagaaaatgatacactggtgatggcgtcaaagaaagatatgtttcttcggattgactgtgcacaaattccgcagaaaaagaaaggtgcggtgggcgtgcgtggcatgaaactggctgccggggatgaactgaaaagtattcatgtgctgcatgaaggtgaggagaaagaggtcgaggtgaaaggaaagccggttgccctgcatcgtctgcatgtgggaaaccgtgataccaaaggagtaaagaaataatgaacaccattttgtttgatctggacggaacgcttattgattcttccgagggaatcataaaatgtgttttatatacgcttgatttttacggaattaaggagccggatacggcaaaattatatcggtttatcgggccgccgctttcggagagttttgaaagatattatggattttcgcatgaaaaagcgtatgaggctgtgcagaaataccgggaacggtacaataagaccggtatttttgagtgtaagttatatccgggtgtggagaagtgtatccgtacattaaaagaacagggataccggattggcatggcatcttccaagccggaagtatcctgcaaacggattctggagcattttggaattcttccgctttttgatgatgtggtaggtgcaacatttgatggtacacgggataaaaaatccgagattcttaaggaagtcatgcgccgctggagtcatattccaaaatccgagatgtgtctgatcggggatacgatgtttgatgtcaacggggcgaaagaacttggaattgcgtgtcttgcggtcagctttggttttggagatgtaaaggaaatgaaagaggcaggcgtgatcggtgtgtgcgattctatggaagaactgccgggcatgttaaagaaataataaagaaaaacgggagggtatatcatggaaacttttaaggagacgctgagaaagatctggtatatcttatacccgtttcttttttattacgcggttatgctgattattatgacaattgcgcagtgggcatttggaggagatgccacacattatgtgttctgtcagctgattgccactgtttttacaattccatccatgcttccgttttatcgtcagggacaggcactggcagggattgcaaagcagccgtttggaatcagccgggaacgtatctgtcatgcactttttgcggccgggatcatggcatgctttggaatttctttgaacaatctcatatccatgacgaaactgacggaaatttcgatgggttaccagcaggcaaataccgatttttacggaagtacaataggaatggaaattctttgtctggcagtatttaccccgattctggaggagctggtattccgggggattctttttggaagattaaaagatatgctgtcgaaaccgtttgcggttggaatttcggcattgatttttgcggccgtgcatgtcaatatcgtgcagttcatttacgcattgattcttggtgtggtgctggcacttctgatggatcgtgcgggaaatgtctatgcatccatgatcggacatatgacggcaaattttattgcagttgtgcggacggaaacgcactggctggatttcagcgtcaggggagatgcggtctcatggatattttctctggtggtactgggagccgggattgtgctgatgtggaggtatttgtctgacagaaaaaagcaggaagataaggagaaagaataaaatcgaggtaatataatttgtaaaataaacagagaggcgtatactagcgcgtttcgcaaacgcctaataaaagacaatagaaaaaagggagtacaaaagaagatgaaatgtttatggaaaaaagtaatttgcggggcacttgtggctggaatgctggcacagtgcccacagagtatttatgcagaagatgccgcaaatactgccacggtaacggataccgagagtaatcatgtaacaccggatactacgcagcagccggatgatacaaaacagccggatgatacccaacagccgggagatatccagcagccggacgatatccaacagccggaagaactgccacagccttctgccgtggagggactgcatacaacaaaacagggaaaaacaaaggtatatctggaatgggaagaaagcagcgatgccacttcctatgtgatttaccggaaaacagccggaggggaatacaaaaaacttgccgagaggagtaagccatcctataccgataaaaacgtatcatccggtaagacatatacatataaaattgttgcaaaaaacgagcagaaggaagcggatgaggctgcaaaagtcacgttttccaatacaaaagccgtacagatccggtcacagaagtatacttacagccagatgaaaaaagacatgcaggaactggaacagaagtacagcaactactgtgaaatgacaaaaatcgggacctctgtgcaggggcgtgccatctatgattttgcaatcggaaatccggatgcagaggaatcattactggtagtcagcaccctgcatgccagagagtatatctgttcggccgttctgatgaaggaactggagtattatctggaaaattataatgggacgattggcggggtaaaaccggcaaacacattaaataaaatacagatccattatattgttatggcaaatccggacggggtaacggtttcccagaccagacattccacatggaagtccaatggacgcggtgtggatttaaaccggaatttcccggcaaaacattttgtttccggcggaaagaaaggtgcacaggggtattccggcaaaaaagcactgagtgagccggagtcctatgcagtagcaacgctgaccagacagctgatgaaacagcaaaatctgcagggtgtggtgaattaccatgccatgggaagaattatttacggggactgtacgaaaggaagcctgaaaaaagatacctataaaatgtatgatatcgcaaagaaaattaccggatacagcaaagccccggatagcggcagcggaaagtcctggggaggacagtaccgggagtatgtgatggatctgcttaataaaccttccattaccattgagattggaagctcagtagcaccgtgcccgtattggcagtatgagatcgaattccagaaaaacagatatgttgttgtgcggattgcaaatgcattgaaatagaaaaaaatcaggatactttgacgcatctgccggattatgctagtataggggaaacagctgacagatgaggagagtaaaaatggcatacatattttttgatatagacggaacgctgtgggatgaaaaaatgcagattccggaaagtacaattccaaccatcaaacaattgcagaaaaacggacataagacatttctgtgcagtggaagatcccgcagcaatataaacgataagcggctgcttgggatcggctttgacggaattgttgcagcatgcggcaaccatgtggagatggatggaaaggttctgtatgaaaatatcctttccccggaacttacaaaaaaaattgtccgggtcatggaagaatgccggatgccgattgtgctggaaggtccggactgccactggatagataaagaaaatttcaagacagatccgtatgtgctgtacctttttgaggcaatgggagcatctgccaaaatattaaaaggctattcaccggacatccgcattaataaaatgtcgggggatatcctgccaacaaccgattatgccagaatccgggatgaactgggggctgattttgactgtctggagcatgaaggacatgttgtggaatttgttccgaaaggaacatcgaaagcgaccgggatagactggctctgcaggcatatgggtattaaaaatgaggatacctatgcgattggtgacagtgtcaatgatctggatatgctttcttttgtgggacatggaattgccatgggaaatggaacacctccggcaaaagaggcggctgaatttgtgacaacggatatctacgatgatggaataaaacatgcaatggaacactatggattaatatagagtctgaatcgaggcagaaatgaaaaaaagaattacagagtaccggaaacgtgtggaccggcttctggcagacgaagaagagaaaacatatgaggaatgggaatgtattttggaagaacatctggttcagattggatttttccagcacgaacgtctgattcatctgattgtaacggttacatttgctgtgataacggtactgtcgttgtttgctccgcttttgacggggatcatgacactctatggttttaccatgctgctccttgtgcttcttgtgccgtatatttttcattattatacacttgaaaacgaaacacaaaaaatgtatgcacagtacgatgaaataataaagcatacaaagaaagtgaattccgggaatctaaaaaaaatataaaaattgagtatcactgttgacaatgaaaaacaacagtgatattttatttacagaaagagttagcactcgaataaagtgagtgctagtaaagacgaaaaggaggctatttgtaatgaaattagtgccattaacagacagagtagtattaaaacagttagaagcagaagagactaccgcatccggtatcgtattaccgggagcagcacaggagaagccacaggaagcggaagtaatcgctgtaggtcctggcggagtagtcgatggcaaagaaatcgttatgcaggtaaaagaaggccagaaagtaatctattccaaatatgcagggacagaagtaaaacttgatggggaagagtacattatcgtaagacagaatgatattcttgcaattgttgagtagtttttataaattggaaattataggctgaattttaaagaagagaggttattgtagtcatggcaaaagagatcaaatatggttcagacgccagagcagcacttggtgcaggtgtcgataaattagcaaataccgttcgtgtaacattaggaccgaaaggacgtaacgttgtactggataaatcctttggtgctccactgatcacaaacgatggtgtaacaatcgcaaaagaagtggaacttgaggatgcatttgagaacatgggtgcacagcttgtaaaagaagttgcaaccaagaccaatgatgtagccggtgatggtacaactaccgctactgttttaacacaggctatggttcaggaaggtatgaagaacctggaagcaggagcaaatccgatcgtgttaagacgtggtatgaagaaggcaacagatgccgctgttgaggcattaaaggaaatgagccagaaggttaagggcaaagagcagatcgcaaaagttgcagcaatttctgccggtgatgaagaagttggtaatctggtagcagacgctatggagaaggttacaaacgatggtgtcatcacaatcgaagagtccaaaaccatgcagacagagcttgacctggtagaaggtatgcagtttgacagaggttacttatctgcttatatgtgcacagatatggataagatggaagcaaatctcgatgatccatacatcttgatcacagacaagaagatttccaatatccaggatatcctgccactgcttgagcagatcgtacagtccggtgcaagacttctgatcatcgctgaggatatcgagggagaagcactcaccacattgatcgtaaacaaactgcgtggtacattcaacgtagtagctgtcaaggctcctggatatggtgacagaagaaaggccatgcttgaggatatagcaatccttaccggcggtcaggtgatcagctccgatcttggattagaactgaaagataccaccatggatatgcttggacgtgcaaaatccgttaaggttcagaaagagaacaccgttatcgtggatggtgccggagacaaggataagattcagggacgtatcaaacagatccgtggacagatcgaggagaccacttctgaatttgataaagaaaagttacaggaaagacttgcaaagatggcaggcggcgtagcagtcatccgtgtcggtgctgcaacagagaccgagatgaaggaagcaaagcttcgtatggaagatgcattaaatgctacccgtgcagcagtcgaggaaggtattatcgcaggtggtggatctgcatacatccatgcatccaagaaggttgcagagcttgctgattccttagagggagatgaaaagaccggtgcgaaggttatcttaaaggcactggaagctcctttgtattacatcgttgcaaacgcaggtcttgaaggtgctgttatcatcaataaggtaaaggaatctgcaccgggaaccggtttcaatgcagctaccgaagagtatgttgacatggtagaatccggaattcttgatccggttaaggttacaagaagtgccctgcagaatgcaacatccgttgcttctacattactcaccacagagtctgctgttgcaaacattaaggaagatactcctgcaatgccagccggtggtgctccgggaatgggcggaatgatgtaatcggacataaccgttgcgttataaagtaaacatagtatcaaaaaccatgtgaaatagatatgaaaagccttgaaaatcaaggcttttcattttttttgtcctatgatatgatagaaagcgtaacggttcaaagacaaaggaaccgtttggaaaaacaacgaaaatcaggagtggaaaaaatgagtcgagtgattgttgtaacggacagtaacagtggtattacacaaagcgaggcaaaagaacttggcgtagtggtaatgccgatgcctttttatattaacggacagatgttttatgaagatattgacctgacacaggagcagttttatcagaaactcaaagagggcggagagatcaaaacctccatgccgctggttggagatgtgaccgataaatgggatgaacttttgaaagaatacgatgaaattgtatacataccgatgtcttcgggcttaagcagttcctgtgagacggcatatatgctttcccaggactatgacggaaaagtacaggtagtcaataaccagcgtatttccgtaacaatgcggcagtccgtgctcgatgccaaaatgctggcagagcagggaaaaggtgcagaagaaatcaaagagattctggaaaaagaaaaatttgaatcctccatatacattatggtcgatacactggagtatctgaaaaaaggcggacgtatcacacctgctgcagcagcactgggaaccttactgaaactgaaaccggtattacagatccagggagaaaagctggatgcatttgcaaaggcacgtacggtaaaacaggcaaaaacaatcatgaccgaggctatgaaaaacgattttgagaagcgttttcacagcccggatggggagaagatgaatctggaactggcctatacatttgacactgcagccgctgaggcattcaaagaagaagtgcaggctgtctttccggacaatgagatcgtcatgcagccactgtcattatccattgcctgtcatatcggaccgggagcacttgcgatcgcatgttccaaaaagattgaagcgtagcaggaagtttttgggaactttcatatgctaacaaattaaagtttatgacttgtaatttcagtgggaatcctttataatcataaagtaaaaacggatgggtttttacacctgtccgttttcgtgcgtaaaaaagtgcgcacggaaagttaaagcagacatacaggaggaataaaagatggttaaagcagttgttggcgctaactggggcgacgaaggcaaaggcaagattacggacatgcttgcaaagcaggccgatatcattgtacgttttcagggaggtgcgaacgcaggacacacaatcgtaaatgactacggaaagtttgcattacatacacttccgtccggagtattttacagtcatacaacgagtgtgattggaaatggtgtggcacttgatattccgcgtcttttcaaagagattaagtccatcacagaccgcaacgttccgatgccaaagattcttgtgtccaaccgtgcacagattgtgatgccgtatcacgtactgtttgatcagtacgaggaggaacgtctgggaggaaaatctttcggatcgacaaaatctggtattgctccgttttattcagataaatacgcaaagatcggttttcaggtaagtgagcttttcgacgatgagctgttaaaggaaaaggtagtccgtgttgcagagcagaagaatgtaatcttagagcatctgtatcacaagccactgattgatactgatgaattattaaatacattacatgagtaccgcgatatggtagctccatatgtatgtgatgtttccttattcctggacaaggcactcaaagaaggaaagacggttctcttagaaggacagcttggaacattaaaagatccggatcacggaatttatccaatggttacatcatcttccacactggctgcatacggtgcaatcggggcaggagttccgccatatgagatcaaacagatcattaccgtatgtaaggcatattcttctgctgtaggtgccggtgcatttgtaagtgagattttcggagatgaggcagatgaactccgccgccgtggtggagatggtggagagttcggtgcaaccaccggacgtccgagaagaatgggatggttcgactgtgtagccagcaaatatggctgtcgtctgcagggaacaaccgatgtggcatttacggtacttgatgtattaggatatctggatgagattccggtatgtaccggatacgagatcaacggagaagtgacaaccgaatttccggttaccagtctcttggagaaggcaaagccggtactcacaaagcttccgggatggaaatgtgacatccgcggtatcaagaagtatgaagaacttccggaaaattgccgcaagtacattgagtttatcgagggacagattggatatccgatcaccatggtttccaacggaccgggaagagatgatatcatttaccgtgagtcttctctgaacaagtaatcgaaacaagtaacagagcctgtaaaaagcagcgaatcgaatctgatccggtttgctgcttttagagtataagaaagcctatgcagatagaagtaataattgaaaaaaaatcacataaacttgatgcagaagaaggaaaaaccattttagagacacttcaggaacatggaatccatgtgctgacggcaccatgcggtggcaggggaagatgcggaaagtgtaccgtagaggtggaacatatgggggaggtactcgcctgtatgacaaaagtaaccgatgggatgcgcatcacaattccgaaagtgcagcttcgcgcacagaagtctaaaattgcagaaaacggaacggtcacacattatccggcggatgacggagaagggctggatgcggcatgcgatatcggtactacgacggtggtctgccatctgatcgatggaaagacaggagaaaagctggcaacggtcagtgaaccaagcgcacagagaagttttggtgcagatgtgctttcacgtattcaggcagccgaagcaggaaaactggaaatattaaaagaacagattatttttcagatcgcacagatgcttcggacactgcagaaaaaaacagggagaggggaacagattcatcgtcttgccgtggtgggaaatacggtaatgtgtcatctgtttgcgggaatttcgcctgtttccatcggggtgacgccgtttatgccgcaggaattctttggaaaagagtataccggagagcagctgggacttacggattgcagatcggtatacatagcaccggcggttgcaggatttgtcggaggagatattacgtcggatcttttggcagtgatgcagaagaaacccaaagagaaagtgcttcttctggatattggaacgaacggagagatggcggtcggaaacgaagatcagatttattgctgtgccacggcggtcggatctgcatttgaaggtgcggagatggcgatgggaatgccggcagcggccggagcgatatcccatgtctggctcgaccagcgaagaatccgggtgcaggtaatcggagacgaggaggcgtgtggtatttgcggttccggtctgattgatgcacttgcggtaattttagagatggggcttctcgatcacacaggattgttaaagcagaaacagtcggtctcagttgcttaccggaaatacctgggagaatatgcagggcagccatgtgtctggctggcgcataaggtatgtgtgacgcaggaagatatccggggactacagcttgcaaaggcagcatttgcagccggaatgcggattctgctacaggacagtcatacttcttatgaacagctggatcatgtcattctcgcaggtggttttggcagctatctgaaaaaagaatcggcagcggcgattggactgatcccaaaggaattacttccgattacggattcagttggaaatgcagccggagaaggcgcagtatcagcagctatttcaaaaaaagcaagagagcagctttccataattcagaaaagtatgcattatatagaactgtctacccatccggatttttcacaggaatatatgaaccagatggattttgatggaagcgagcgatagaaagggaaaaaatgatagaactgatagaggtattaaaagccgtattatttggaattgtggaaggcgtgaccgagtggcttcccatcagcagtaccgggcatctgattctgctgaatgaagtggtcaaactgaaagtaagtgatgaattttacagcatgttcgaggtcgtgatccagctgggagcgattcttgcggtcgttgttttattctggaaccagatctggccgtttggaagaaaaaacaatgtagcacctttgacaaaacggggaccgggcgcatggatcaaaacagatatttttaaattgtggtttcatattctggtttctaccattccggcagcggtgatcggtgttcttgcggatgactgggtggaggaacatttttacaattaccagatggtatctgtcatgttgattctgtttggtattgcgtttattctgattgagaattcccataaagggaaaaattccagaatcaattcgcttgcagatatcggttacgatacggcactttttatcggtctgtttcagctgatcgctgcaatctttccgggaacctcccggtctggtgcaacgattgtcggagcacttttgatcggagtgtccagaaccgttgcggcagagtatacgtttttccttgccattccggttatgtttggtgccagtatcttaaagattgcgaagtttggactggatttttcgacatccgaggtcgttatcctgtttgtgggatgtgtcattgcatttgcggtttccctgattgttatccgttttctgatgggatatattaaaaaacacgatttcaaggtgtttggatattaccggatcattcttggcgtttttgtgctgacgtgtggatttttaggagcattacatgcttaaactatatatccggccggtttatctcctgtgtccggaagaagaggtggcttcgctgtctcttcttgtggagagccgcagggagaaagtaagaacgataaaaggaaaagaaaatcgcagcagatccattgcggcgggacttctgctccggtatatgctgctggaagaacagattccttatgccgaagaatctttcggactggaagaacatggaaagccgcgtctgaaaaaagatggggttttctttaatttaagtcatgcgggagcatatgtggcgggagtgctgtcggatgtcccggtaggtgtggatgtggaacagcagaaccgttttttgcaggaaacccgcaaccggaaacttgcaaagcggatattaacggaagcggaatggaactggtggaaagatgccggggatgatccgcaggaactgctccggttctggacaagaaaagaaagctatgtgaaaatgaccggggaaggaatgacaaaggcatttcataccgtggatgccctgcatgggaaatactataaagaaattccgttgggaacgccaaaagacagatatctgatcagtgtctgtacgcagaaagataggacttgcgattttgtatgtaaaatgttagattaatatctggaggcagaatatgcatgatgaattaacaaaaaaggatattgaaaaaatggaggcagagatcgagcaccggaagctggtggttcggaaggaagccctcgaagatgtaaaagaagcacgtgcccagggagacctgagcgaaaattttgaatataaggcagccaaaaagtttaaaaacgaaaatgaaagccgtatccgttatctggaaaaaatgatcaagacagcagtgattgtttcggaagactctccggaagatgaagttggaatgaacaataccgtcgatatttattttgaagaggacgatgtgacggaaacatataaactggtgacaacagtcagaagcaattcactgaaaaatctgatcagccgggaatcaccgcttggcgcagctattttcgggcataaagccggagatcgctgtgaagttcatgtaaatgataattattcctattttgtacagattaagcgtattgtcaatactgtggatgacggcacagatgagcttcgaaaattttaacaacaggagacaaaaataaaatgaaagtatcggaaattttaaagaagaatgaggtgaccatctcatgtgagatttttccaccaaaacagggagcacagctgcagaattataaggcaattgcagcagaaatcgcaaagctgaaaccggcatatatcagctgcacatatggagcaaccggcggaaccagtgattataccgtagagattgcagatgcgatcaactcttatggggtgccggcaatcgcacatctgacctgcgtctcttccacaagagaaaaggtacatactgtaatccatgagctgaaagagcgcggaatcgaaaacatccttgcacttcgcggggatattccgacaaacacggattttccgcttccggatcagtatcaccatgcgattgagctgattcgtgagatcaaagaggcaggagacttctgtatcggcggtgcatgttatccggagggacatccggaggctgccaatatgaatgaagatctggatcatctgaaagaaaaagtggatgcaggctgtgaatatctgaccacacagatgtttttcgacaataacatttattatcgtttcctatataaggcacttgctaaaggaattgatgttccggtgactgccggaatcatgccggttaccaatgcagcacaggtgaagagaacgatttccctgaccggaaatctggttcctgccaaattcttaagcattgtggatcgttttggggacaaccctgcagccatgaagcaggcaggaattgcctatgcaaccgagcagatcattgatctgattgccaatggagtcaaccacattcatatttattccatgaataaaccggatgtcgcagcggcgatcatgaataatctgtcacagatttatgtgagagagcaggcataagaatgaagaaaaaggaagaacagctggtccgtaaagtgaccgatatgatacaaaaaacgcgggaaggaaaactgcactgggatattcagtgccagactaccgagtacaacgacccggcgaagaaaccagtggaaaccgaagagggagagacatgggtgattgatgagtgttttgtttcctatcactgtatggatcaggaaaaagaatttctattgatttcttatgagcagatctacacctgcggagagaaaaagaagtcctgcaatttgatttttctgccaccgcttggcgttcgtttctttgatgtggatgttctggctccgtatgcggtggaggcggatcagatgctgatctacgaagtacatatgctgtggctgaccgtgcttgagcagtataaaaaagatccacagagcatggaactggatgtgacagggcgcgagctggtactgcagcaataaacatgaatatacaatgtgtataataagttaaaaaaacctctggaatttttagacaaaatttccagaggttttttggcagtttttccaactttatttcgtataaattttcaagtataatgaaaaacgaaaaaacccgaaaaatcattcaaaaggaggaaaaaatgggagagagaaggttttcaacaaagaaccgttttgtaagttttttacttgcaattgcgatggttctgacacttttgccgattggggcggtacaggcgaaggcagaagaggcagctgtaaaattatattttgagttgccaaacggaacatcagtaaatgattggtgtgtaaatgcatgggggaatagcgtaacaattagtggggatgaagaacacaaatttcgtccttctacgtggggagaggttaatgaaaaaaatcctgaatttcctgcgttatttcaagcagatgacaaaaaatggggttatgtaacaatttccggaactatagatggtttgcagtttgttaataaagaaggtaaagaatacaaatgctggaatgctcaaattgcaaatgaaggacataaagaagcatattttgatccttcactggaaaaatggtatacaagtgctgaaaaaacaacagtaattaaagctgctgaaattaaaaatacatttacacttgcaggagattccagattgactggaaatagcagctgggatgcaaaagatgaaagaaatgtattagtgcaggatggttcagatacaaataagttcagtataacgtttcatgatgttgcaaaaggtacatattcgtataagattttacaagatcctgaaacttgtggctgggataaaccttggggatatggaactggcagtgatggtaaccgcagtgtgacaatagaagcaccttcagatgttacgtttaccattgatcttacagatacatcaaaaaatgtagaggttagccagaaaaagttaaagaaaattgtagtagacaatggaaatatttccaaaggcaaaacaaaagaattaagtacatcggcagagtattatgatggaacatctgctgatgtaaaaacagtaaccgtttcctatcagttaaaatcaccaatggaaggtgtgacattggatggaaataagcttactgttgcaaaggatgttaattcaacagaagtgattgttattgcttcctatggcaattttacacaggaactgtcaattccagttgtagaaaagcagtatcaggtaaccataaatatgtattctcaggatttggaaatgaagcccggggtatcggatatttacatttttgagaatggtgggagtaacaataacaatacgactgttactttaaataaagcggtagaagatacagaaaataatgtaacatgggtacagggaacggttacggtgccatacaattcacttggaattattgctagagataaagctggatcttggaaggatggacaagatggtaatcaattttataccattgatgagaatgcttcagaagtaaccttatggtatgtgtatggaaaaacacctgtcacagtaaaacctaccattaccaaagaagatccaagatatttttatctggaatatgaaaatgatactttaacaaccaatccggagttttattcgtggacgactggttttgcagcagaattgaaaaactttgaatctgcaggagcaggaaaatggaagatcaaagttcctgttaaatcaacttgtacgaaggttgatttcgtggttgtgctggatccttccggctctgactggatcaaggatggaggagatcactccattgcattcccacaagaacagaacgttgtatgcgcaagcatgaaaaaaggggaagaacctgtattgagtgctccatacaataagggatatgaagtccttccaaaagaaaataagattgcattttattatcgggatgataacgccttaattgatgataagcttgcagatatgaaggtatctgtagatatcaatggtacggaatatgaaatgacttataatgctgggaataagcgttttgagtataactataacaaactggaaagcggacgtacatattatcgttataaagtcggggatgaatatattttagacaaatataacgataagcaggaacaaaaagggggaaacgattattcttatattgagtattataagctgaatgctactattcaggcagaggtaatgaatgcgtcatttaattataatgagaataatgtcgtaaaatttactgtaaatcaggatgagaaagatgagaagaaattagaagttgcatcagcaagcattgatgtttcttctttaggtggaagcagtacattggcaattgtaccggatttgcaggcggtaacaatatcagccacaacagatacttcgctaggtaaaaaaacattgccaattgttgtaacagatcagtatggaaatgagtattcaacaagtgtacaggttgaagtgactgctcgaaccaagaaaaatgcgaaagattttgattgggatgaatccgttatttattttatggtaacggaccgcttctttgatggaaatgaatcaaacaatacagcaagcggagcacagacttacggaaaggataatgcaggtctgtatcatggtggtgatttcgcaggaattacacaaaagttagactatttagaggatttgggaattaatacaatctggattactcctattgtagaaaatattccgggagttaaggtcactgacacgggaaaagaagatgttccgtacaatgctgcataccatggatattgggcaagcgattttacaaagctgaacccaacgcttggaacagaagaagaatttcagacattgatcgaccaggcacacagccgtggaatccgcattatggtagatattgtggttaaccatgccggatatgatacagattttggtaatatgatccgaagcggagacgatattgtatctggaagtgatcagaaagattccttaagcaatttaccagattttaaaacagaagatcctgcagtcagcgcgcagcttgtaaagtggcagacacagtgggtgaaagattttggtatcgactatttccgtgttgatacagttaaacatgtggaaaatgatacctgggcagaattaaagaatgctctgacggaagtagattcagattttaagatgattggagagtatgcaggaggaggctatgcttctaatggcaatactttaggaaccggagaaatggattcggatctggattttgattttaatgatcaggcaactaattttgtaaagggaaatatttcttccgtagaaagtttcctgacatccagaaatagtgtattaaacaatacatatatgacaggtcagttccttggaagtcatgacgaggatggatttaagaagaaacttttggatggtggaatggctgaagatgcagcaactgcggcatccatggtagccgcaagcctgcagattactgcaaaaggacagccggttatttactatggggaagagatcggtctgacgggattaaataattatccatatcagacaaaccgttatgattttgattggacaatggtaaacagtgacaataagacctatcagcattataagaagatgctttccatccgtaatgcatatacagatgtattcgcaaggggtgacagaaaaacaattttagcatctgatgaaaatggttatgatattgtatccagaagctacaaaggaacaaaattatatgttggtttaaatatcaaagatgttgcacagactgtagaaattccggttagtgaaaataatggaactgttttgaaggatctgtattctggaaaaacatatacggtaagtaacggaaagattaaagtgatcattccagcggcaacagatggtggcaccgttgttctgaaaaataattcaagtacaaacggcggttctaccggtggaagttcttccagcggaagcacaacaactcaaaccaagccttctgaagatatcaaaaaggatacaacaacgatcgttattcctgcagaaaaacttccggaaggaacgactgcaaccgtaacagtcacaaaggatgcaagcggaaaagtaaccgcagaggcagcagtagcagcaactggaaagacaagcaaaacaggcgtgaaagcaaccgtaaatgccgatgtgatccaagctgtaacagaagctgccggaacgaaagacgtaaccatcacacaggaagtcaagaaagcagatggaacaacagcatacaccttacaggtaaatgcagcagatgtcaaagcaggtgcaaaacttgctgtaatgaagaaagatgaaaagaccggggaactggttcttgtaaaccggaaagcttacaaggtcgcaaaggatggttctgtctcactgacatttaagggtgagggaacttatgtcgtaaagacacaggctgaggtaaaggctgaggcaaagcagatcgcaaaaaccgttaagccagcaaagaccacagtaaatgttgctacaaaaaagacaaccgtatttaaatggaacaagaagctcaatatggaaaacgtggcaaagattacctataagtcttccaagaagtctgtggtttccgtaaataaaaatggaaagattaccggaaagaagaaaggaaccggaaaagtgaccgcagaggttacattaaaagacggaaccaagaaaacagtaaagatgaaggtaaaggtgaaataagccagaaccttaaaacaatcgttttatactcattttctgccatagggcttacagggggaaacctctgtaagccctgattttattagacaaccgggggctgctgtgttatactcattatgctttaggaggatgtaaaatgaaaaaaacatatgcagttattacaggggcaagctctggaattggtatggcatttgcaagacagctcgcggcagaaggataccgtctggtactggttgcgcgacgggaaaaccggctgcaggcactggcggaggaattgaaaaaaagtgggacggaaagcatggttatcacggcagatttgtccgaaaaagaagcgtgttaccgtctgatgcagcagctggagccggttccggtcggaatattgatcaacaatgccggttttggggattgcggcagttttctcgagacagatgcagagaaggaaatgcagatgattgatgtgaatgtcaaggccatgcatcttttgatgaaactgatgcttcgccgcatggaaaagcaggagggcggttacattttaaatgtcgcttcttcggcaggactgcttccggcaggcccttatatggccacctattatgcgaccaaagcctatatggcgagtctgacgcgggcagtggcgctggaactgaagcagagaggcagccgggtgtatgtaggggcattgtgtccgggtccggtgaatacggaattcaatgaagtggcaaatgttgaatttacactggccggaatcacaccggagtattgcgccggatatgcattaaagcagatgaaaagacgcaaagtgctcattgttccgacgactgaaatcaaggcagcaacgatatgcggaagatttattccgcaaaatctgctgatcgcaattactgcacatcagcagaagaaaaagctgaaagcagaggacatataaaatggaagaaattaaaataggctctcatgtgggaatggcaggaaaagagatgtttctggcatccgtgaaggaagcggagcgttatggagcaaatgtgctgatgctctacacaggggcaccgcagaatacccggagaaaagaaatcaaagacttaaatattgaggcgggctgggagtatgccacaaaggctggaatccgggaaatcgtggttcatgcaccgtatatcatcaatcttgccaatacggtaaagccggagacatttgagcttgctgtggaatttttggaaaaagagatccggcgcacggctgccatgcgcagtaaaattctggtactgcatccgggatctgcattagacgcgggggcggaggcaggaattgcacagactgtccggggactgaatatggtgcttgatgccaacggggatgatgtgtttattgcgttggaaacgatggcaggaaaaggcagcgagattggaagaacgtttgaagagattagggcaatctatgacggagtgcacaaaaaggaacggttaagagtctgttttgacacctgtcatgtgaatgatgccggctatgatctggtgcatgattatgatggcgtgttcgagacttttgatcaggtgatcgggctggatcagattgcggtttttcatatcaatgacagtttaaatcccctgggagcacataaagaccgtcatgcaaacattggaaaaggaaccatcggatttgaaccattgtaccgtctggtccacgatccgcgttttgtggaaattccaaagattttagagacaccgtggctttgtgccgagggagagaccaaaaagacgattccgccatacaaagaagagattgcacagcttcttgcaaaataattaggtaattgcgaaactcgcgatgctcgttcgcaaacttgaatcaaaatagaaacagaattgagcatagcatgattttaatgacgaaaacggatattgagctgttttaggcgcacttaaataagccgtagactttattgagttggtaagtcctaagcaataagaggttttaagctgcgaataaattcgtgatgattgattttatccgaaagtacaactgttattagttgggtaattcctgcaaggatcagatcggcgtgaagtgttttctcattctgagttcttcttccggccagacaaagattatccttgatgtggttaatatctctttctacggtggttctgattttgtaagtgttattccattcttctgtaccacggatagcgccaggataggcacggagatccttttcaggataaatatacaccattctgccacaagaagaagctgtacatggatcatcacatgtacagtgacgctgggatctgccagtagatgcatttttgatccacttaattttaggacagacaaacttatatctggtaacaccgcttctgagttttgatattccttcatatttcatgggaagtgaatcatcatgaggacagcagggaatcccattttcattaatcgtgtagtcctgtttttcaagaccagccctggaattcagtgggatataagctttatcaaagtgtttatgatctccgaacgtattaccggtaagaagtttgggatagagtgccgcagtatcaaaagcagcatcgccaagaaaagttttgggattaatcaatggatgctttaaaaagaaatctttcagggttggaattaaaagcctggaatcatggacagacttgtcttcatcaggtgaatcagatttcttttcaacggtaatgtcaggatgggaagctataaagtttttgttataaaaagcgatatgcctgatgattccaagaccgttggtaatgatgccaaatttgaagacataacagaaatgcccattgatgtataactgtttaatttcaggattagcagacgcgtgcgaaggcatagaaccataagcggctttataaggatcataattcttgtcgaagctgttagcttttgcataagccttaagctgtctgataatgcggttagcatacttgggattattctcagtaacaaaagcttcaatgccagaagaatcaaagatggtcatatcggcttttgcggaatcaacagcctgacagattggttcggtgatatcaacaagtttatcaaaaacaagctgcagatcatctaaaaagtcctgtttgaagcgtgtaatcttagaggcatcagggactttggtaaaaccgcagaaatcacgaagaggtttcgagtaaaccagaaaagttaaaagaagctggtctgtagggattgagaagatacgctggataatcaaagcccacaggaaagcacgtaaagggtatttacgggatcttcccgttgatgcatagaaatgatttctaaaagaaatcggaataaactcatcaatatcgatatgggtttctaatagagaaagaaatgcaggcttgtcattattaaatttattttggcaatcttgaaaaatatctgccaaagaaagctgtttatatggtatcatatgtatcagaataactcctttcttgggtacatggtttgtagtttttagtcaactctattataccatatccggtgaggagttattttaatttggtaacaaaaaatgccgtatttatgcggtctgtggcgttttgcaaacgcctattgcaaaataataataaagaggagcaggattatgaacgttaaacaacaggggatttccggctattggttaaaggtgatcgccgtgatttccatgctgattgatcacacatcggccgttattttagaacagattccgggactggaaaatcccgcatttttgatgcgcatcattggaagactggcgtttccgatttactgttttcttctggtagaaggattttaccatacacgcagcagggcaaaatatgcggggaggctttttttgtttgccctgatttccgaggttccgtttgatctggcattcagcaggagaatgtgggatttttccagcagcaatgtcttttttactttgctgttcggacttttggtgatctggggtgttgaaaagataaagcagaagtttgtggcggatgtttacggggaaaaagcagcagccatccgtgtgattcttatcattgtgacagttgcagccgggggatttctggcacttcttttccgtacagattacgatttgtcgggaattgtgacaatttttgcaatttacatgttttatccgaagaaagtgaagggaatgggtatcggtgttctggttttaaccctgctggcaagtatcattgaagcagcagcatttctggatatgataccgatttatttatataacggaaccagaggaaaacagatgaaatatttcttttatatattctatccagcacacctgtttcttcttgccatgatcgcacgggcaatgggactttgggcttaatattttaagaagatgttacgattcttatgaaattcttatctttttcagatacagcttgcgttcctgaaaaagcgggagtacaatgcagacgaaatgaaagacagataggaatggaggtcttggatgatgagacaaaaatcttggaatcagtttaaaaaaacaatggctgcctcgacactggcaggagcgatcacttttacagggtgtgcggtgatgccttcggttacagcttttgcagatacaacagaacagaccggtcaggtatcgtatgataatgaggtgatgccgatccacacggacgtgaagacggaggcaaaaccgttgatgaagggtacgtcatgtacggtttcggatggaaagaacctgtattatgcgtttgaaatgatgggtgtgcgtatgggaattatgaaatacaacaccaaaacaggcaaaaagagtgaggtatattcctacaaaatagggaaaaacaaaaagggaagcaatggtttttcccaattatctgtggataagaaatatatttatgcaacctgggaccgttactatggaaccgatgcaacaaaagaatatatttaccggatcgcaaaagacgggaaatccgcaaagaaacttgcgctcggacgtgatccacagcttgtagatggacggatttattatctggcactgaaaagtaaaagtgaagatggcatgaattattcggaagataccggaaccgttatgagcatgaagacggacggaacggataaaaagaaagttgcacagattgtaaacagcggagatgcttatcggtattccctgtttcagagtgagggaaagatttactataccaaggaaaacgagaacaagacattttatgatctggagggaaacagttatcagagagaggcctttgcggttaaggatgaaaattatctgagtgtttcgctggaagccgtcaatgatggaacgtatacctaccgtacgacaggaaaggatcggtacatgcagacgaaactctaccggacagataacaggacgggaaagaaaaaccttgtggcatcctttaaacttggcattgaaaaatactcggtttgtggaaattatgtattcgtggaagcaaatgttccgtacaagggagctgatgtgactgagaaacttgcagtttactgctataaggcagatggcagcagcaaagtaaagcttgcttcctggtttccggcagaataaaatccgggtaacaatcgaaaaaataaaagaagcaccgcgactgcggtgcttcttttattctggggatttatttatccagatcttttttatctacattctgcagcatcattgcacgaactttcagaggaagtccgaacagtgtgatgaatccgtctgcatcgtgatgatcgtactgatcaccggttgtgaaacttgccagagactcactgtagagagagtatggagaagttgtgccggctttgatgatgtttcctttatagagcttgaattttacttcaccggtgacatacttctgggtagaagtaacaaatgcctggattgcttcgcgaagaggagtgaaccattttccttcgtatacaacattggcaagacggttgcccatctctttctttgcagataaggtatcgcggtcgagaaccagttcttccagctggtcatgtgcttccataaggatcgttccgccaggagtctcatatacaccacgggatttcataccaacgacacggttttctacgatatcgatgatgccgacaccgtgctttccaccgagacggtttaattcacggatgatatcggaaactttcatttcttttccgtttaccgtctttggaacacccttttcaaatgtcatggttacatattcgccttcgtccggagctttctcaggggaaacaccaagaaccagaagatgatcataatttggctcgtttgcaggattctccagctcaagtccttcatggctgatatgccataagttacggtcacggctgtaactttggtctgtgccgaatggaagatcgattccgtgtgctttgcagtatgcgatctctgcctcacgggaatccatctgccacttgtcatcacgccaaggagcaatgattttgatatccggagcaagtgctttgataccaagctcgaaacggatctggtcatttccttttccggtagcaccgtggcagatggcaacagcgttttcttttctggcgatctctaccagtttctttgcgataccaggacgtgccatggcagtacctaataagtatttgtgctcatatacagcaccagcctgtacacaaggtacgatgtaatcgtcacagaactcatctgtgatatcttcgatatataatttagaagcgccggataatttggctctttcttccagtccgtctaattcttcgccctgtccgcagttgatacagcagcagacaacctcataaccataagtctcctttaaccaagggataatagcggtagtatcgagtccgccggagtaagctaaaacaactttttctttcataagattgtatcctttctttctatatggaattgtacgctctcgtacgactaaccctactatacatcaatccaaatgaaaacacaagtgaaaaaatatacataaaattgcataaatatacataaatttgtgaatatttgctatttacggatggaaaaagatggactattatagggtagaatcatatttttaaaagaaagaaaaggtaagaaacatggtaaaggtaggaattatcggagcgaccggttatgcaggagcagaactggtgcgtattttattgaatcataaagaggcacagatcgaatggtttggatcaagaagctatatcgatgaaaattatgcagatatttacagaaacttttttgaacttgtcgatgcagactgtctgggtgataacatggatgagcttgcttcccgcgtggatgtgattttcacggcaacaccacagggatttctggcaggtgtgctgaatgaggatattttaaataaggtaaagatcattgatctgagtgcggattttcgaatcaaagatgttgctacctatgaaaaatggtataagattgagcataaaagcccacagtttattaaggaagccgtttacggactctgtgagattaaccgtgataaggtgaccacccagacccgtctgattgcaaatccgggatgttatacgacctgttccattctgacagcatatccgctggtaaaagagggactgattgatccggatacattgattattgatgcaaaatccggtacttccggagcgggacgtggggcaaagacaccgaacctgttctgcgaagtgaacgagagcatgaaagcatacggtgtgacaacacacagacatacaccggagattgaggagcagctcggctatgcggcaggaaaagagattaccgtgaattttacaccgcatctggttccgatgaaccgcggaattcttgcgacagagtatgcaaccctgatcaaaaagccggatggtacctatccttcttatgaggaactgaaggctgcttacgataaatattatgcaaaggaacgtttcgtgcgtgtattaaagaaaggtgtctgcccggagaccaagtgggtagagggcagcaattacgtggacgtaaactttgtcattgatgagcgtaccggcagagttgtgatgatgggtgcactggacaatctggtcaagggtgcagccggacaggccgtacagaacatgaatctgctgttcggatttgatgaggcagaaggactttccatggttccgatgtttccataatgaaaggcatctgtttgatgcatttcctacgctcattgtttccgcgtaagcggaactctcatacaatgagctctataatgaggtgaataatgagtaaagaatatacaatccgtgtgatgacactggaagattatgatgaggtgtatgcgttgtggatgggcatccacggttttggaatccgttccatcgatgattcaaaagaaggagtggagcggtttttaaaaagaaatccgaccacgagtatggtagcggtagcagatggaaagatcgtgggagccattctctgcggacatgacgggagacgcggatgtctgtatcatgtctgtgtgcacgaagattaccggaagaacggaatcggaaaagccatggcagtcgcatgtatgcgcgccctgcaggaagaaaaaatcaacaaggtcagcctgatcgcatttaagagcaatgagctgggaaatcatttctggaaagatgccggctggtgtttcagggaagacttaaactattacgattttacattgaacgaagcaaatattacgagatttaatcagtaaggagaatgttatgagtgagaatttaaacgcattggaaaaagcacaggtgctgattgaggcattgccttatatccagcgttttaaccgcaagattatcgttgtaaaatacggtggatcagcgatggtagatgagaaactgaaaaaacaggtcatccaggatgtcaccttgttaaagctggttggattcaaaccgatcattgtgcatggaggtggcaaggagatcagcaaatgggttgccaaagcaggaatggaaccggaatttatcaatggactgcgtaagacggatgcgcctaccatggagattgcagagatggtgttaaaccgtgtcaataaatcacttgtatccatggtgcaggaacttggggtgcaggcggtcggcatcagtggaaaagacggtggtctgttaaaggtggaaaagaaattgtcggatggtcaggacatcggatatgtaggagaagtaaaggaagtaaatccaaagattctgtatgatctgctggagaaggatttccttccgattatctgcccgatcggtcttgatgacaattatgatacatataatatcaatgcggatgatgcggcatgtgcgattgcccgtgcggtttccgcagagaaactggcattcttaaccgatatcgagggagtatacaaagatccggaagatccgtccactctgatttccgaacttacggtttccgatgcaagaaaactgattacagacggatatatcggcggcggtatgcttccgaagctgaataactgcattgacgctattgaaaacggagtatcccgtgtgcatattctcgatggaagaatcgcacattgtctgcttttggaaatcttcaccaatcgcggaatcggtactgcaattttgggtgatgaagaacatcatttttacaatgaataagagataagaggtgtggataaacaatgaataaacaggaatatattgataccgcggagcaggaactgctgcatacctacaatcgtttttcacttgtacttgatcatggtgagggcgtatacctttacgatacagacaaaaaagcgtatctggatttcgcagccggaatcgccgtatgtgcgctgggctatagcaatgaggcgtataaaaatgcgctgaaggatcaggtggataaactgctgcatacgtcaaatctttattacaatgtcccgaccattgaggcggcaaagaaagcactaaaagccagcggaatggatcgtattttctttacaaacagcggtacggaggccattgagggagccatcaaagctgcaaaaaaatatgcatataccagagacggacatgccggccatgaaatcattgccatgaaacattctttccacggaagaagtatcggagcactttccgtgaccggaaatgcccattatcaggaaccgtttgctccgctcatgccgggtgtgaaatttgcagagtataacaatttggaaagtgtaaaagaactggtaacggacaagacctgtgcggttattatggagacggtacagggagaaggcggaatttatccggccgatcctgcatttatcgagggcgtgcgcaggctctgtgatgaaaaggatattctgttaatcttagatgagatccagtgtggcatgggacgtaccggcgagatgttcgcatggcagaattacggagtaaaaccggatatcatgacctgtgcaaaagcactcggatgtggagtgccggtcggtgcatttttcctgacacagcgtgtggcagacaaatcgctggcaccgggagaccacggaacgacctatggtggaaacccatttgtcggagcagccgtttcggcagtatttgatcagtttaaagcctgtgaccttttaggtcatgtaaaggaagtagcgccttatctggaacagaaactggatgagctggtagaaaaatatgacttccttgtaacacgcagaggcaaaggtctgatgcagggtgtggtttgcaagcttccagttggaaaagtggcagccgcagcacttgagcagggactgatcgtgatcacagcgggagcggatgtccttcgttttgttccaccgcttgtcatcgaaaaacagcatgtggatgaaatgattgaaaagctggaaaaagcattactttctgtgcaggaataacttacacttgtaaaagtaacaaaaaatcgttaaaatagaaatgcattgagactcgtttcgccccggaaagggagaaatgagatgaaaaaacattggataaaaaagtgctgtatgattctgacatgcctgtatctgacgggatgtggcagggaggaagtgccatatctggataccacgcagacacaggagcagactgtggaaacggaacgaacggaacaaaaagaaacattaaaatccgaccagacggtacaggtatatgtatgcggggaggtagcagctcccggtgtctatcagctgaaagacggtatgcgcatctgcgatgcggtggaggcggcaggaggactgaccaaagttgccagccgcgaatactggaatcttgccgagaagctttcggacggacagatgatttattttcccacagaggaagaggcaagggagcggaaagcatctgcagaggcagccggtgcctctgtgcaggaggaatcggacgggcggatcgatatcaatacggcggatgccgcgcagcttgtgaccattccgggaatcggagagacacgggcggcggcaattcttgcataccgggagaaaaacgggccgtttgcgaaagtcgaagatatcatgcaggtatccggaatcaaaagcgcactttttgagaaaatgaaagattatataacgattcgttgaggtgtaatatggcaaagaaagttctcgtagtagatgatgagaaattaatcgtaaaaggaatccggttcagtcttgaacaggacgggatggaagtggattgtgcatacgatggagaagaagcgctgaatatggcgaaagcaaatgagtatgatatgatccttttggacatcatgcttccgaagatggacggattcgaagtatgtcaggcgattcgtgaattttctgatatgccgattgttatgctgacagcgaagggcgacgatatggataagattctgggactcgattatggtgccgatgactatatcacaaagccgtttaatattcttgaggtgaaagcgcgtatcaaagcgatcatgcgtcgtaccgcaggaccgagagaaaagaaagaagtttcttcgattgtggagaaaggggatctgcgtctggactgtgacagcagacggctgtttatttcaggcagggaagtaaaccttaccgcaaaagaatttgatctgctggaacttcttgtgaaaaatgaaaataaagtatacagcagggaaaatctgctcggactggtctggggaaaagattatccgggagacgtgcgtacagtggatgtgcatgtacgtcgtctgcgtgaaaagatcgaaaccaacccaagtgaaccgaaatacgtgcacacaaaatggggtgtgggatattattattaccagaaatagacgagaaggcagaaaggtttttccatgcagaagagtaaacagtttcttcagttcttaaaaagtttaaaatttcggctgattcttttgatcgttgtgattgcgatcgtaccgagtctgattctttcggcagcagttttaaaatattacgaaaagcgtgccgtttctatccgggaaagtgaaatcttaagccaggcaaaaattctggcaaatcagatagcgacaagtgaatatatgaagctgggggcggatgtatcgtccagcaatattcagacacagattgatatgctcacgaccatctatgatggtcgtgtcattgttgtggatgacaactgcaaagtttattatgacacgtataatctcgatgaccataagctgatcattgcagaggaggtcatgcgcagtttcaagggcgaggatattgtgcattatgattcggagaaccattacattgagatgacgatcccgatcagcgatcctgatgataaaagtgaaacggtgatcggagttatgctgatcagtgtttctacggacaatattgtgatcaaccagtcatatatgcgacaggtggcggtgatcgttatggtcatggtcggaattgcaattgtgttttttgcaatccttctgcttttgtatttcctgaagccgttgcagaagattgaagagggaatcgctgcaatcaaaaacggatacggagagtacaatcttcaggtcaatgattacacggagacggcgggaatctgtgagaagatcaatcagatgcttggccggatcaaagtcatggatgattcccggcaggagtttgtatcgaatgtgtcacatgaattaaagacaccgctgacatccatgaaggtgctggcggattcgatcaatagcatgccggatgcgccgaaggaactgtatcaggaatttatggaagatatcaccaacgagattgagcgtgagacaaagatcatcaacgatctgctttctctggtgaagatggataagtctgcagcagggctgaatgtatcttccgtcaatatcaatgaacttttagagcagattttaaaacgtctgcagccgattgcggataagcagaaagtggaacttgtccttgagagtttccgcccggttaccgcagaagtggatgaggtaaaaatcacgcttgcgatcacaaatcttgtggagaatgcaatcaaatataaccggaatgacggagagggctgggtacacgtatcgctgaatgcggatcaccagtatttctacctgaaagtagaagattccggaatcggtattccggaggagtctctggatcatatttacgaacgattttaccgggtggataaatcccattcccgtgagatcggaggaaccggactgggacttgcgattacaagaaattccatactgatgcatcgcggcgcaattaaagtacattctgtgatgggcgagggaacaacctttgatgttcgtattccgctcaactatattgcataggaggaaaaagatgagaaaaaaaataatttcaatcatactccttgtggcaatggtactcacaatggctgccggatgtggaaaaaaagaagataaaaaagactattttgtattttatgtaaacaatgagctgacaaaggttgttgcgaaaaagattaccctgcagcatacttcatccggcaaagcacaggtgaaggaactgctcaaagatctgcagacacagccggaggatgcaacgcttcgaagaaccattccacgcaaagtaaaaatccagaatatagatctgatctcttatcagattacggtggatttcagcaaggaatattacgatatgaaaccgacggaagagattctgaccagggctgcaattgcaaagacactgttgcagctgagccagtatgtgacctttactgtggatggaaaaccacttgtggatgcctcgggagcaaatgtaggtgccatgaatctggacagttttgtggaaaatccgggagaacagatcaattccagccagaaagcaacactgaaactttatttttcaaataaggcgggtaccagactggttccggaaaccagagaggtacattacagttccaacatttcactggaaaaactggtgatggaacagctgattgagggaccaagaaaaagcggactcttggcaacgattccttcggagacgaaactgattacgatcacagtggtggatggggtctgctatgtcaatctggatgaaatgtttttgaatcagaatcaggaaatctcagaacctgttgttttatactctatcgtggattccctgacggaattgacgggaatcgataaagtacagatttccatcaacggagacaccagtggcaaatgccgttacacgtataaactatcaaagatgtacaaggcagatgaccggctggtcacaaaagaaagcgatgagaaagtagaatctacggaataggaaaagaaagcgtgaggaaaagaccatttcttttgcttgccacagagtttctgctggggattgtgtgtgtcagagagcagctgccggcatggggtgtgctggcagttctgttactggtatataccactccatggaaggaacgggggatgcggaaagttctgtttgcggcaggacttcccggtatgtttcttttggggatgctgcagatgcagcgacagatcgatttcaggcagcagtacctgcagaaactcacagatggccaggaggttcgcctggcgggaaagattgatcggatagaaccgaaaaccagatgcgtttattactatttaaaagattgcacggtggaagcagaatcgcagacactgccatgcaatgatgtaatcgcatatgtttcttctgccagccattcggctggacaaatcctgaatattgagggtacaatttcattatttacagaagcatccaatgaagggatgtttgatgcccggcagttttaccagagtcagaaaattgatttcggcatatgggtcacaaagatcagccgggtctatggaaaaccggatcgttaccggtgcgcactacagaatatgaaaaagcgtgcaaatgacgtgatccggcattctatccgggacgatggcgtgctttctgcgatgctgttaggggaaaagggggctctggatgcagagataaaatctttgtatcagagagcggggatcgcccatgtgcttgctatttccggacttcatatttcccttctggggatgggactgtaccgcctgctgcggaaacgactgcatacccggtatgtgacagcagcgctggcaacgaccgtttttttgatttcctatgcggttttaagcggaaacggggtatctacacagcgggcggtgggcatgtgtctgatttatttgtttgcggatgtgacaggatatgcctatgacatgttaaatgcgcttggaattgttgtgctcgtacttttgtgggaaaatccgtttctgctatcgtattccggatttgtgttttccgtgatggcggtgattgccatcggagtgggagccaatgtactgctggaatgggaacattcatggaaatgcagacagcaggccggagaggaaaccatcaaaaaaacatttttctcaagacaaaaagaaggaattctggtaagttttgcaatccagttgtttaccatcccgctggtcgcatattcttattatgaaattcccgtgtacgcgatgctgataaatctgtttgtacttgcggtggtcaacggattactggggcttactgtgcttggggtgattgtggggatggcgtttttgcctgcggggcgtgttctgtttgcgccctgtggctggatgctcgacagttaccggtttctgtgtgaggtttccttaaagattccgggtgcgcagaggatcacagggaaacctgcgcatatgcggatcttttggtattacctggggcttggagtgtttcttctggcgatctatgcctgtgcacgcagaaatgaaaagcacaaagactgcagggaaacggcagatctgtgtgtaagccgaagaaagaaacgactgcagggcatagttttttcctgttttattgcgtttcttctgctttttcttctttttccacagaagaaatcgtttgagattgatttccttgatgtgggacagggagacggtatttatctgtgcacgggcggcgggacttccatgtttatcgatggtgggagcaccgatgtgaaacaggtgggaaagtaccggattctgccgtttttaaaggcaaaaggagtgtcagagatttcttactggtttgtcagtcatacggataccgatcatgtgtccggtcttaaggaggttcttgtgtccggataccgtgtggagtatctggtgtttgcaaaagcagtggaaaaagaagcaaagacaaaagagctggcagaactggcccgcagccatggaacgaaagtgctttatatgcaggcgggggatacagtaagaagcaaacgtgcagccatgcgctgtctgtatcccaaagcttcggataaagcggaggatgtcaatgatctgtgtctggtactgcaatttgaagagggggatatccgcgccctgtttggtggagatatctctacagatgtggaagagcagctgctccggcgcagaaaatgggataaggttttgatttttaaggcggatcatcatggatcgcgctatgcgaacgcagaagcgttattgaagtgtatccggccggaaattacggttgcttcagccggaaaggataaccgttacggacatccgagcccggacgccgtacaaaggatcaaagagagcggcagcagatttttttgcaccatcgaaggtggacggatacgggtgtgcgtcatcgaaaataagctggtgtgcgaaacttatgtgaaatagagaaaattattttccggcactgtactgtaccagaaacagttcaacggccatctggtcattcatgtgtccggtttttactgcagtttcgtattccacaccatcgcggatcgcctgtttgagctgatccatggaaaaagcacggctctgcgactggtatttgcggactgcccactccgggcagccggcttttaaagcaatttctttgttgccaaatccctgattggtcatggatttgacaatcatcagacgctgaaactggctggaaagcagaaaaagaatacgcatcggagcttctttgagagcaagaagatcataataaagatccagtgcctttttctgctggtgcagtgccactgcatcaatcatgtcaaagattttattctcggtctgttcggtggtgatggcttccacatcggagatatcaatatagtctttttccagtgtgtagcagagaagtttttccagctctttgtcgatattttccatgtcatcaccggttttacggataaagagcgcataggcatctcttgtaatattttttccgtttctgcggattcttccctcgatccagcgggagagagtcgtctcattctgacgcggaaattccacgatgcttccgttttttttcacctgcttgtacatctttgttttcttgtctatttctttttccgcaaagacaaaataagtggtttccggaatggaagacatgtaatcggcaagttcttcggcgctttttttaaacagaccgctgtcttcgatcagaatgagtctgcggtcggcaaaaaaaggcagtgtctctgccagatcgatgatctctttctggttgatgtcgctgccggagaaagtagaaaagttcatggtatcatcatccgctgccagtgcatgctttaatttgtcccggtactggcggatcagatactgttcttctccgtatagcagataaatctgtttgaattgtcctgttttgatgtcgttatcaatcgttttcatgtctacattatatacatattggcagacttttacaactttttttcaattacatcttgacagaagggacagcttgacatattatattctagtatgtttgcgatgaagcgtccgtgtctgtttcaccgcaggaaacaaattacagtttgatatggaggtgtacagattggctaacattaaatctgctaagaagagaattttagttacagagacaaagactgcaagaaataaagcaatccgttctgaagttaagacttcaatcaagaaggtagaggctgctgttgctgcaaaggataaggctgctgcagaggctgcatataaggatgcttcttcagttatcgagagtgcctgctctaagggtgtatatcacaagaacaacgcagctcgtaaagtttcccgtttagcaaaattagtaaacggaatcgcttaagatctgaatattataaaagaagaaggactgccagtaccgtcatgctggcagtcttttttgtttacaaatacgtgggagaatgatacaataaacagaggaactgatacagcggaggaaaaaatgtctggattattgttggagctgcgcagacagattgcgcacaatcgtcggaaagctgcatatgaagaacggatgcgtgcatctgctcaggaaaaaccgcaggaggttttttcgcagaagacaaaagagacaaagccggacacggaaatacagcccgaagtacaggaaaggaaagttaatgttgtgagcagggaagatttcttacttagccagattgatgaattcagagaacgcgccaagcagttacagtcgttgcttgattccagagagacggaggcacaggaactgcagacgttagtggatgaacgtcaggagaaagcagatgctctggggcagattctcgaggagcgtcagaaaaaagcagatggattcactgcggaagtggaaaagcagattgatcgtctgatcggcaaagtgtctgccaagatggaagaaatcgaagtttccatgaaggaagatgtggcagacggcaaacgcttaaatgaagaaaaagcaaaggaactgaaagattctcttgcgcagatcgaagaacagctgaccacggcaaaaacagaaatctccgagaaagtacatacagaaaatgtaaaatgctaccgaaatatttcggatctgttccgcagcatggatgaacgcctggacaagcttaccgttatggaaagcagaatgcatccggtccgtattttttccctgacgggaatgatacttggaatcgtgaatctggtggtgttacttttggtcctgctggttagtgtgggcgtgattgcgttttagaataaggatatgcaattctcaaaagaatgaggattgcattttttgtctcaaaaaagatatagaacaattcgaaaagagaaatgtgaataggagaatctgatatggcaaaaaagaaagtttgggttgtaggacataagcatccggatacagactccatatgtgcagcgatttcttatgcaaacctgaaaaatgaaatagaaaaaaagaatcccaaaacagctacgggaatgacctatattgcaaagagagccggatctgtaaatgcggagacagcgtatgttctggaaaggtttcatgcagaggccccggcaatgatttcggatgtcggaacacagatcaaggatattcagatacgccgtacagagggagtaaacagtcatatctctatgaaaaaggcatgggagatgatgaagatcctcggggttgttacgcttccggtggtgcgggaaaataagctggaaggactgattgtaacaggagatattgcaaaatcctacatggatgtatatgataataccatcctttctaccgcacgtacccagtacaagaatattgtagagacgctggacggacagctgctgacaggaaatgaacatgcgtattttgttcacggcaaggtggtaatcggaatcggtacaccggaaggagtgacttctgccatagacaaggatgacctggttatgatcggggacggggaagagtcgcagatgctttccattgcatcaaactgcagctgcatgattgtcactaacggatatgaaatcagtcaggaagtgatcgaggcggcaaaggaacgcgaagtcgttctgatcagtacaccgtacgatacgtttaccgcggcccgtctgatcaaccagagtatgccgatcaagcattttatgacaaaaaatggaatcattcattttgatctggatgattacgtggatgaggtaagagagaccgtagccaatatacggcatcgggatttcccggttctcgatgaaaaccagaactatgtgggtatgttttcccgcagaaatttgatgaaagcagagaaaaagaaactgatccttgtggaccacaatgaaaaatcacaggcagtatccaatatcgatgaggcggaaattttagagattatcgatcatcaccggctgggcagccttgagaccatgtctccggtgtatttccgcaatcagccgcttggatgtacatccaccatcatttatcagatgtatctggaaaagggaattacgatcacctcgcagatggcaggactgatgtgtgcagccattttatctgacacgctgatgttccgctcaccgacctgtacacagatagacagggaagcagcactccggctggcagagattgcagaggttaaggtcgaggagcttgcctcagcaatgtttcaggcgggaagcaattttgataataaaacagaagaagaaattttaaatcaggattttaaaattttccatgccgaggatgtgagttttggcgtggcacagatcagcgcgatgggacgcaccgaactggataaggtgcaggaacgtatcgagccgaaactggaacagatgatgggagaaaaacagatccagatgatttttgtcatgctgacggatatcttaaatgagtctacttatctgatttatcgcggtgcggatgcatcgcagctggttgcggcagcttataattgcgagccttccgatcaggggattatgctggaaaatgtggtatccagaaagaaacagctgattcctgcgctgatcaacacccttgcagagcgcaaaatgtaacaggcagacagatcaattgcgctgttctctgggagaacagccaaaatgtttgcggtatgcccgggaaaaggtggaataattgtgaaaaccacaggcataacaggcggtggtgatggatttcccctgggcgatctgatctcttgccagcaaaaggcgcttcgtggtcagatagtttccgatcgtataaccggtttcttccttgaaggcatgcatgagatgataccggctcagatagaaatgttcggcaagaaagtcgatggtgatgtcatctgttaaatgtgcatttaaataatctatcacatggatcattttatgatttgaggctgtggtagaaagatattcaatgcggttggagagagctgcacggtttaattgcaccatcagctccagaaaaagaagtttatgataaagttcgtttgcgtattctctggaatccagagattgttccagatcgtggataattcttgcaatctgtgttgtcttcagtgccggaatacgcagtacatgcgattttttctgatgcgcttcttttaagcagagtgagagatcgtcggaatcatgacaggcatccaggtagtgtctggaaatatagatgatgatgcgctcataaatttcagaactgtgcagaaccggacggtggaccgtacctgcgggaacgaatacgatatcccccggtatcagatcataggtacgtccttccacattgtaagaaatatttcctttgcgaaagatcagaattttatgaaaatcgtggtaatgaaagtcaatcgggtgcatagaggtatcttttaagtgaaaaatcttaaaatcgtcatgaagatatcctgttttttcataatgtgagagttctgacattgcataaatctcctgtaaatattaattagattcagtgtactatgtttccacacaatttgcaatataaaaagcactgtagttgttttagaagacggatcgtgcgggtatacttagaatagaagctctgaatcgacaggatggaaaagaaaaaaggagtgtagaaatatgaagtttacaaaaatgcatgggtgcggaaatgattatgtatatgtcaatttgtttgaggaaaagatagcagatcctgcaaaggtatcaattgcagtgagtgaccgccattttggaattggatcggatggtctgatcactattggcccatcggatatcgcggatttcaggatgcggatttacaatgcggatggctcggaggcggagatgtgtggaaacggaatccgctgtgtcgcaaaatatgtatatgatcataaaatgacggataagaaagagattacgattgaaaccggagccggggtaaaaacgttgcagctgacggttgcggatggtaaggtttcgctggttcgtgtggatatgggagaaccgatattaaaaccggatttaattcctgtagatgcatcgggagaacaggtggtagatgagccgattgaagtagagggcagagagtggaagatgacctgcgtgtcgatgggaaatccacatgcggtaatttttgtggaggacaccgaacattttgaactggaaaaatacggtccggagtttgaacatcatccacggtttccaaaacggaccaacacagagttcgtacacgttatttctccgacggaagcatccatgcgggtgtgggaacgcggatctgcggagacgcttgcctgtggtaccggaacctgtgccacggttatggcatgtatcttaaatcataagacagaaaataaagttctggtgcatctgcggggcggagatctgaccatcgagtatgatccggataacaatcatatttatatgaccggaccagcgacagaagtgtttcatggaatttgggaggaaaattaaatgaaaattaaagaacttatcaacgaaatggaatatgagatactggcgggaagcgaggagacagagattacgactctggtatatgattcccgcaaggttgaaaaaggttctgtgtttgtgtgcatcagcggaagtgtgcgtgatgcacatgagtttattccggatgtggcagcaaagggagcagcggccattgtcgtagaaaaggatgtaacgccgatcgatggaattacatatatcaaggtagaggacagccgtctggcacttgcctgcatgtctgcggcatattttgggcatccggcaaaaaaattaaagacgatcggtattaccggaacaaaaggaaaaacaacgacaacctatatggttcgttcgattctagagtctgcggggatcaaaaccggactgatcggcacgatcgaatcgattgttggttctgagcgtattccttctgcaaatacgacaccggaatcttaccgggtgcaggagctttttgcaaaaatggtagatgcgggactcgatgctgttgtgatggaagtctcttcccaggcgctgatgcttcaccgcgtatccggatttgtgtttgatatcggcgtgtttaccaatcttgaaccggatcatatcggagaaaatgagcacaaggattttgcagattatatgcactgcaagagtcttttgttccagcagtgcaggcatggaatttttaatggggacagcgagcatctgcagggcattttacagggacatacctgtacggttgagacgtttgggtatggagcagaaaatgatctgattgcgcagaaggtagagttaaaaaaggagcatggggcacttggtgtaaaatatcatgtgggaggttccatggattttgatgtggaagtcaatgtgccgggaaaattttcggtgtataattccctgaccgccattgcaatttgtcatcattttggtgtcagtgttgaagaaatcaaaaaggcgatgcttcatgtaagtgtcaagggaagaattgagattgtaccggtaacaaagagatatacgctgatgattgactatgcacacaatgccatggcactggagagtctgttaacgaccttgaaagagtatgagccgggcagactggtctgcctgttcggatgcggaggaaaccgtgcaaaatcccgccgttatgagatgggagaggtatcttcaaaactggcagatctgacggttgtcacatcggataatccaagaaatgaagaaccaatggatatcatcaatgatattctggtcggggtacacaaagccgatggtgcatatgtgacgataccggaccggaaagaagccatcaggtattgcatggaacatgccgaggatggcgatatcatcgtccttgcaggaaaagggcacgaagattaccaggagatcaagggcgtgaagcatcatatggatgagcgtgaactgatcgcggatattatccgggaaaatacggatctgaaattataacaggattataaataacaggaacaggcaaaaggagtggaaaaatgggaaaacagagttggaaagcgggaaatatgttaaatccggtgccggctgtgatggtcagtgtggcggatcagaatcatcggccaaacattattaccgtggcatgggcaggaaccgtctgcaccaatccgccgatggtttccatttccgtccgcccatcccgttattcttatgagatcatagagaaaaccggagaatttgtgattaatctgaccaacgaaaaactggcaaaggcctgtgattactgcggcgtggtcagcggaagagatgtggataaatttaaaaaaacaggacttacaccggttccggtggagcatgtgaaagctccggcaattgcggaaagtcctgtaaatattgcctgcagggtggtggagagccatccgcttggcagtcatacgatgtttgtggcggaagtacttggcgtgacggtggatgatgcgtatctggatgaaacaggaaaatttgacatcaacggaaccgggcttatcatgtattcccacggagaatattttgctctggggaaaaaactcggcaaatttggatacagcgtacagaaaaagaaaaaatgacacgcggcttattgcagcagcgtgtccatcagtacagcatatacatcttcacttttctttttccagttattgcagatggcttctgcctgttcttttgtagttacgcaaagcgtcaggtcgatcagaggattgccgtcagaccgtacctgacagcgtactgcgtatttctgattggttgtcttatagtaatctgccagaatggaattttcctgtcggaattctaatttattcttttcaaaaaatccctgaacatcattttcaattccatcatttaatttatctttgaaaaatccaagtgtttcttttcccgcagaagtcagagagtactgtgtgttgctgtgcgtggactctgcatggattaaattggcatcgaccagatccccgattacttcctgtacacggaaatagtctgtgtattcctgttccagaaagaaattggaaatctgggtgttggaaagcggaaaccctgctttgctcagcatatataagatcgtaagtttatagattgtaaatggttcagccataaaaatgttctccttgtctggtattgcgttctttgagacggcgatgaatggtgtttaaaatgcgttttttgtctgtgctccaggacggggcgagtaatagactgcggggaccatctcccgtcagacggtgaacgaccatgtccgggggaagaagttccaggcagtcgatcacaaaatcgctgtattcatcaagttccatcaggggaaacggatgaagctgatactgttctgccagtgcagtgccacgcaggacatgcagaagctgcagcttgattcccgaaaccggaagtgcggcgacatgccggacggtatctttcatcatttcttttgtttcaccgggaaatcctaaaataacatgtgcgatcacagagattccaagggcatgaagtttggatacagcggcatcaaactgtgcaaccgtggtatgcgtgttcatggcagacagcgtctttgcatggatgctctgcagaccaagctctatccatatgggtttttcctgattgagatcggagaggagttctaaggtttccggaggaaggcagtcacttctggttcctatggaaagtgcaacgatttcttccggtgccattgcctcggaatagagctgacgcaaaacgtcaacgggggcataggtgttggtaaatgactggaaatacgcaatgaatttctggcagtgtgttttggcggcgattttctgtctggcctgtatgaactgttcagaaaccggcagaaatgcatctgcggcaaaatcaccggagcctccggcactgcagaatgcacatcctccgtaagagagtgttccgtcgcggttgggacacgtcatcccaccgcttagactgagacggtacactttttccccgaagacctctttacagtaatcgttcagagaatagtagcgattagcggacatgagacttgactgcttcacttacaacttctgccacacgtggatcaaatgcttccggcataatgaaatcttcatttaattcctcgtcagaaaccagggctgcaagtgcttctgctgctgcaagtttcatttcttctgtgatctgggtggcatgtgcctccaatgcaccgcggaaaataccagggaaagcgatcacgttgtttacctgatttgggaaatcgctccgtccggttccgacaacttttgctccggcagctttggccacatccggcatgatctccggcaccggatttgccatggcaaagaggatggcatccttattcatggaagaaaccatttccggagtgacaatgtttggcgcagagacaccgacaaagatatccgcaccgcgcagtgcgtctgccagcgttccggaggcattttcgagattggtaacctctgtcatttttttctgcatccagtttaagttcggataatcttttccgatgattccttcacggtcacacatggtcacgtgtttgaaaccgtaagtcagaagaagtttggtgattgccacaccggcagatcctgcaccgtttaccacaacgcggcagtcttcttttttcttgccggtcacacgcagaccattgatgataccggccaaaacaacgatggcggttccgtgctggtcatcatgaaataccgggatatcaagcatttctttcagacgttcctcgatttcgaaacaacgcggagcggagatgtcttccagattgataccgccgaatccgggagctatatttttcacagcctgaatgatctcttcggtgtcctgagtgtccagacagatcggtacagcgttaacatttccaaattctttgaataatacacattttccttccatgaccggcatagcggcataaggaccgatatttccaagaccgagaacggcgcttccgtcggaaacaacggcaaccgtgttggctttccaggtgtatgtgtaggcagcagttttatcttccgcaattactttgcatggttctgcaacacccggggtgtatgcaatcgcgagatcctcgcgggtttttacttttgattttgcaacggtttcgagttttccgttccattctttgtggcataaaagtgccttttctttattatccatagtaattttctcctttacatactcatacttattcacaataccattcttgcgcatgaaaaaaaagacttcctattttaccggaaatagtgtataatagctgcattagataatatttgaaatgattcatagtcgtttctgactgatatcccatgcaaataagtgtaatttatgaaatgatttacggtacgaaacaagtctatattttttaagaaggagcagatggaatgagggaaaaatatgagagcctttctttggttgtgttaaaagacctggcaaaggcacgcgggctcaaaggaatctcaacaatgaaaaaaggagagctgattgatcggatgctgcaggaagatgagcgggagaaagagacagcaccgaaggcaaagacggtatataccgcgcggacagcttccggacaggaaggaagaaaacatacgccaaaacagcgaagggaagagcatccgtcccatacggaggaacacaacagcccggagcatggagagaacgtgcatgcatcgcaggagcagacctataaggtgcaggaggataatgacagtgctgcgatcaaagaagatatcgtcagcctcgacagtggaaatacagcgagcggtattctggaggttatggcagacggattcggttttatccgctgtgaaaactatctgccgggagaacatgatgtttatgtggcaccgtcccagatccgcagatttaatctaaagacaggggatattgtctgtggaaataccaaagtgaaatccgagcgggagaaattttccgccctgctgtatgtgacttcggtaaacggatatcatccttcggaagcacagaagcggacaaactttgaggatctgaccccgatttttccgaatgtgcgtctgcgcatggaacgtcccggcggttcggttgcaatgcgtgtgatggatattgtttccccgatcggtaaagggcagcgtggcatgattgtatccccgccgaaagcaggtaagacaacgcttttaaaggaagttgccaagtcggtaaaggaaaacaacccggagatgcatctgatcattctgttgattgatgagcggccggaggaagtaaccgatattaaagaggcaattgagggagaaaatgtagaggtcatttattccactttcgatgagaccgcagaacaccataagcgggtatcggaaatggtaatcgagcgtgcaaaacgtctggtggaacataaaaaggatgtgatgattctcctcgacagtatcacacgtctggcacgtgcctacaacctgacctgtacgccgagcggccgtacactttccggtggtcttgatccggcggcactgcacatgccgaaacgattttttggtgcagcccggaatatgagagaaggcggaagcctgaccattcttgccacggcactggtcgataccggaagcaagatggatgacgtggtatttgaggaatttaagggaaccggtaacatggaacttgttcttgaccggaaactttccgaaaagagaattttcccggcggtggatattgtaaagtccggcacgcgaagggacgatctgctgcttgatccgcaggagcgtgagggcgtggagaatatgcgccgggcattaaacggcatgcggtcggatgaggctgtggagaatattttaaatatgtttgcacacacgcgtacaaatgctgattttatcaatcttgtaagaaaaaacagaattctttaaatttctattgcatttgcatggacgctatgttacaataattaagctgtttatcgggatgtaaacggacgaaagtgtcgctcttgtaataagtatcatatgcggatcgggcatacgggtataaagggtgtgacaggaaccagagtcagccggaagactgattacagaaaacgataagaatataaagaggtgaaaatcatgagagaaggaatccatccagattattatcaggcaaccgttacctgcaactgtggaaacacattcgttacaggttctacaaagccggagatccacgtagaaatctgttctaagtgtcatccattctatactggacagcagaaggctaaccaggctcgtggacgtatcgaacagttcaacaagaagtatggcatgaaatagaattgataagtcacgtaaaaaggttgaggctgtgtattgcctcaacctttttctcttacagggggaaatatgaaatattcaggagttggcgggcaggcagtcatggaaggtgtcatgatgaaaaacgaagaccgttatgcggttgccgttcgcaagccggatcacaccattgatgtaaaagtttctacatttaaagaaacgattaaaaataaaaaactgcggcgtctgccattcatccgtggtgtcattaattttatagaatcactgatccttggcatgcagacactcatgtattcggcttccttttttgaagacgatgaggatgaaaaaaagaaaaaagaagccatgacgcaggaggaacgaaaggcacaggaagaaaaagaaaaaaagcaggagaaggcaatgatgggcggcactgttgcattttccattgtttttgcgctgggacttttctttttcctgccatattttctgtccgggatcttccataaagttattgcatcggataccgtgattgcgctgctggagggactgatccgtctggcaatttttatcggatatattgcactgatttccctgacacctgatattaagagagtgtttatgtaccacggagcagaacacaaatgcatcaattgcatcgaacacggaatggaactgaatgtggaaaatgtccggaaaagttcccggcagcacaagcgctgcggtaccagtttcctgctgattgtaatgctgatatctatcgtgttctttttgtttatccgtgtggattcgcgtattttgcagctggtgctcagacttcttcttattccggtgatcgccggagtatcttatgagtttatccgtctggcgggaagatatgataaccggctggtgaatatactgagcaaaccgggactctggatgcagaagatgacaacaaaagagccggatgatgagatgatcgaagtgggaatcgcttcggtggaagctgtgtttgactggagaaagtggcagaaggaagagaatgtatgacctatagggaagcaattgtttcgggagaaaaaagcctgtgtgaggctggcattgcagatgccagaaatgatgcatggctgcttttgaccatggcatgtaaaattgaccacacttactattatatgcatattgacgaagagatgccggaggaactgcagcatgaatttgaagtgctgattaaaaagagggcagagcgagtgcctcttcagtatatcaccggggaacaggaattcatggggatgacatttcatgtgaattccaatgtgctgattccgcgacaggatacggaaaccctggtggaggaagcactgaaggttgtaaaaccggggatgaaggtgctggatatgtgtacaggttccggatgtgtgctgatcagtattttgaaaaatgtacacggtaccgggggatatggatatgatatttccaaacaggcgatcaatgttgcaaaggaaaatgcaaaattaaatgatgttcctgccattttcgagagaagcaatctgtttgaggatgttgcggatgaaacgtttgatgtgattgtgtcaaatccaccatacatccgcagcgatgaaattccgtttctgatgccggaggtgtcggaatttgaaccgcatgaggcactggacggaaaagaagatggtctgttcttctaccggaagatcatccaggaaagcccggattatctgaccgatggagggtatctgctgtttgagatcggatatgaccagggatgggcggtatcatctatgatgaaagaggccggatttgaggacgtctgcgtgaaaaaagatcttgcgcgaaatgaccgtgtggtctgcggacacaaacacctatgtgaaaagagaggatagattatgtttgataaattagaggatttacttcatcattatgaggagttaatgaatacattgagcgagccggatgtggcaaacgatccgaaccgctttcgtaaactgatgaaagagcagagtgatctgcagccaatcgtggatgcctacaaggaatacaaggcatgtaagcagacgatagaggattcccttgcaattcttgatgaggaatctgatgaggaaatgcgcgaactggcaaaggaagaattaaatgaggcaaagagccgtctgggagagctggaacagaaattaaagattctgcttctgccaaaagacccgaacgacgacaagaacgttattgtggagattcgtgcaggcgccggtggagaggaagctgcgctttttgcggctgaaatttaccgtatgtatgtacactacgcagagcgtcgtggctggaaagtggagacacttgaggcagatgaaaccggaatcggaggcatgaagtcggtcaactttatggtgactggagcaggcgcatattctgtactgaaatatgaatccggtgtgcaccgtgtacagcgtgtgccggagacggaatcccagggacgtattcagacatcaacctgcagtgttgccgtcatgccggaggcggaagatgtagaagtgcatattgatgacaaagacatccgtatcgatgttatgagggcatccggaaatggtggacagtgtgtcaatacgacggactctgctgtgcgcctgacgcattatccgaccggtatcgtgatttacagtcagaccgaaaaatcacagatccagaacaaggagaaagcgtttgcactgctgcgtaccaagctgtatgatctcgaactgcagaagaagcaggatgcagagtctgaggaacgacgcagccagatcggaaccggagaccgttccgagaagatccgtacttataatttcccgcagggacgtgtgacggatcaccgcatcaacctgacattatacaagctggacaagattcttgacggagatatccaggagattatcgatgcatgtatcgcggcggaccaggcgaagaagttaagccgcatggaaaaagatgcctagaagccttgattttactgacttttctgaataatatcggttcttttaaactgaataaactcgtaaggaaaacggtctttgacacatgtcatcgaccgtttttctcatataggcttagttttgatgcactgtatacccctatttagctgactttgatgtatgtatagcccctatctataaaatacttcaatattataaaataggtaatgcttacttgcagaattaagaaagagaaatacgtggcgatttacttcatttggcattgtacacatatgttttgaaggaaaatgtatcatactacacaaaaagaattattattcaaaatatgacttgaacgttcataaaagctattgtattatacgaacacgtcgatgaacggtggttcttttgaacactactggaactataaatttgtctttttatttaatcggaggtaaagattatgtattataatgaagaaaataatgcggtatttgaaacaaaggaaagctatgatatgtatgttaaagcacctagagacgtgaaatcagtaattgatgagtgcaatgtaaatatgcatcatgatattgatgttgttaagcaggaaaaagtgaaatatttgtctgaaaagatttcatcgtattataagacaaataaatcatgtcaggatataattattaaacagatgaatacattgatagatgcatatacaaactactggataagtattgtaaataagtacaacaagatctttttgataaattctaatgaggggtgttcaaaggattgcttaaaggcattgaaaaaggttggagttccacatatagatagaaagcattttcaaatcaccaacatttgatttactggtggtttttggtgtaggtgttgcaaataggtacttttgaggacgttgtgaaatatatgattggctttgcatttttctgtagttttttagggtaagaaataactcccaaaagctgatggggtatcctgctttaaagtttttttactgcataaaagaagttgaaaaaggacataattatggtataattagaccatatagacgaggaggtgtttattatgccacaaataattccaattaaagatttgaaaaatacattagagatttctgatatgtgccacaagacagaggagccgatttatgttacaaaaaatggctatggtgatatggttatcatgagcatggagatttatgagtcaacaatgaaacaaatcgctatgtatagagatatagagatatctgaaaagcagatagaggcaggacaggtaaaggatgccagaacagcacttagagaaacgagggcaaagtatggcttataaattaaatgttacagagcatgccgatgaattgcttgataatcttgtgtatcatttgatttatcgtttaaagaatgaacaggcagcggagcatctgttagatagtattgatgttatctatgacaggttggaggtcaatccttttcagttttcagaatgtagagatgcatatctggcaaagaaagggtatagagaagcagttgtgccacagatgaattatattattatttttgatgtgagagcagatattgtaaatgtagttggtattttccaccagttagagaattatcagagcaaattataatatgttttggggtagacaagagtcagtcgaaaggctggctctaattttttgcacttttctgcagacaggcgaataactgaacagttcatgcaactttttaagaaagattttgagaagttgtttacagagaatgagacgagagctaacatagcacaaacccatgattgggttcaaaaattatacgattggaggattttctatgctattaaacactataactgaaagacatccaaattcttttgttctgttaaagccaaagagcagagataagcagaaccatgtcagggattggaatgttttgaacacagcaaaaaaatatgatgatattttgagggttgcagagtattacaggtcagagggtataagtaatgcagtcatattgtctacaagtgatgagcttgttgttccaccagaggaatcagctaaattctttagggtgtattacaacttattcactatagcaaaggttgttgttcatctacctttaggaggttaggcaatgggattagttgacagagcttgtgatagattctttgagatggcacaagagcgttggagagagcaaggtttcaacgctgatatagtagatattttggacaaatatcgtgaggaaaccaataaagtgataagaagaaataaggttagcgttataactacttttctgattcaactttacggttaaggtaagtgatgaagttatagatatgtttgtggagcgtatcatttatcgtggagttgttgacggtaatgatgagtttgtctgggtgatgaatttatcgggagagtgtacagatacatccgctaagtataagattcgaggttacgataaagattatgcggattctcttaagagtgataagaattttaatattgttgctcgtatgttgattccaatggaagagtgtaaacgtttttgtcaggaagaggcaggcagacgatttaagaagaagtattggaatcctattacaattaagattgcaattgcataatatgctgaaactattaagggctgagcagaacttgcttggctctttttttattttatatataggtaattgcgaaactcgcgatgctcgttcgcaaacttgaatcaaaatagaaacagaattgagcatagcatgattttaatgacgaaaacggatattgagctgttttaggcgcacttaaataagccgtagactttattgagttggtaagtcctaagcaataagaggttttaagctgcgaataaattcgtgatgattgattttatccgaaagtacaactgttattagttgggtaattcctgcaaggatcagatcggcgtgaagtgttttctcattctgagttcttcttccggccagacaaagattatccttgatgtggttaatatctctttctacggtggttctgattttgtaagtgttattccattcttctgtaccacggatagcgccaggataggcacggagatccttttcaggataaatatacaccattctgccacaagaagaagctgtacatggatcatcacatgtacagtgacgctgggatctgccagtagatgcatttttgatccacttaattttaggacagacaaacttatatctggtaacaccgcttctgagttttgatattccttcatatttcatgggaagtgaatcatcatgaggacagcagggaatcccattttcattaatcgtgtagtcctgtttttcaagaccagccctggaattcagtgggatataagctttatcaaagtgtttatgatctccgaacgtattaccggtaagaagtttgggatagagtgccgcagtatcaaaagcagcatcgccaagaaaagttttgggattaatcaatggatgctttaaaaagaaatctttcagggttggaattaaaagcctggaatcatggacagacttgtcttcatcaggtgaatcagatttcttttcaacggtaatgtcaggatgggaagctataaagtttttgttataaaaagcgatatgcctgatgattccaagaccgttggtaatgatgccaaatttgaagacataacagaaatgcccattgatgtataactgtttaatttcaggattagcagacgcgtgcgaaggcatagaaccataagcggctttataaggatcataattcttgtcgaagctgttagcttttgcataagccttaagctgtctgataatgcggttagcatacttgggattattctcagtaacaaaagcttcaatgccagaagaatcaaagatggtcatatcggcttttgcggaatcaacagcctgacagattggttcggtgatatcaacaagtttatcaaaaacaagctgcagatcatctaaaaagtcctgtttgaagcgtgtaatcttagaggcatcagggactttggtaaaaccgcagaaatcacgaagaggtttcgagtaaaccagaaaagttaaaagaagctggtctgtagggattgagaagatacgctggataatcaaagcccacaggaaagcacgtaaagggtatttacgggatcttcccgttgatgcatagaaatgatttctaaaagaaatcggaataaactcatcaatatcgatatgggtttctaatagagaaagaaatgcaggcttgtcattattaaatttattttggcaatcttgaaaaatatctgccaaagaaagctgtttatatggtatcatatgtatcagaataactcctttcttgggtacatggtttgtagtttttagtcaactctattataccatatccggtgaggagttattttaatttggtaacaaaaaatgccgtatttatgcggtctgtggcgttttgcaaacgcctatttattttatatatgatgagaggtagatattgtgatataatataacatgaaaggttacgcaatttggtaaatgtgctgtaaatctcttgtggaattattaatcttgtgtgaaaatgatgaggttattttttacaggaagttttattgagtgataatcattagataacaatttggactttttactgttagcgtgggtttaaaactaatactaatagataagatatggtttgaacagaagtggagaagggtatgagtgcaaaaaaatttgatgagtatgaatataaaaataataatcaaagaataagaattagtttcttaagagatacagaggaaagattaaatccttgggaaataacaaattttgttagtagagtatctacatatatgtataagatagaaattcttaacacaatagcattagcgattaatcaaggtattgagaaaaaggatatttttgtattagataaagcatataaactgaatggaaaatacaaagatttttcagaaattgacctcaatactttagcaatcaatagtgtatatgcaataggtaagccagtaggtatggagccaaaccaagacttggtagaaataaagtatttatttgaaagtctacataaggtaaataaaatcttatatcgatttgctaagaagcgaattacaaaggaagatagattagaagcttataatgttttaaaacaaaaaggttttttgtttgtactgaattttattgttgataaagctaagaacaaggtcgaagatgaagaacgattgaatgtaatcaaaaatgttgaaaatgaatgttcaaaagttttaaagaaatatcaagaatatctagctgataaagaacactttgatgatatagaggcaaaattagaaaaaagtaatgatgaggaattaactgagtctgagaagagggtagaaaaaaattattataaaaagttttatgaacatatctttgttttgccacgtcctgttgttggaatatattataaagaagaaaataagtttagtattttgtgtggagaccattttgatagtagtataaataagaatacaaagattgatttgaaaagcattacacaaaatagtcctattatggcagaaattgagtctggatgtcagattcttgcattaaggaaggaagaaaaaagaaaagaggaacttcatgaactagaaaaaagaaagatggaattagagatagccaagttggaaaaagaaaataagctaatggaacaagaagaagtaaaaaatgaattagatatgttgaataagtcgatagagctaaaaacgagattagattctatggctgaaacagaggaaaacttgggaataaaaagcatggcttcttcgtatgccaataaacaattatgtatggtgtataataaagttcaaaatgggtataaagaagtcttaaaaacgaataaatttattgaggcatctgattccataattgatatgaaagtgtaaaatgtaatgggatatctctttgatttgagaataattgatgcaaattgcagaattttataaagaggtaattgcttcgtgcttgtttcgttggaggcacacgtttcgagcctttttatggcatggaggcatttgttccgagcctacaataaatgaggcaatcgtttcgtgagggcgaccaggcagccaagttaagccgcatgcagaaagagggctaaaatccttgattttactgggtttcttcgaattatacagttgacaaaaaacaataattttatgaaaaagacggactttgacatatgtcatcgcccgtcttttcttattttgggtttctttgatgcactgtacacccctatttgggtggctttgatgcatgtatagccttatctataaaagtgggggtattaactaattgatatggaaaaagaaaagtgaatgtgctaccatcattatggaggtagttcgctatgatacatgattatggatatgaacaggcaataccatacaaatttataaaatataaaaaacaggataaagttgaattcacagaagagataaaatctgagttagacaattactatagggatataagaaaactgacagagtctaattatcaaattgatggaaaagcagatatcaagaagctttctaaagatttaggtggaaagtataagtcaatcagaacaaaatttattattccatttactggaaaagaaagctattcaagtcaggaattggattttctttttgtgtgttgctatgagctctatttgaaattcaatcttagtcaaactgaaatgaacaagatatggggaattaacggagataagcttgaaagattggactggtatccgcatagaagtttttctgcatatcattcagcctgcgataaaacattgaagccttatgatactgattcgttaggtgctaagattgcaaaagtcatgaatcaaaaagtacaagcagtatatatgtgcgtggcatttacagggataacaaatgatttggatttatttgccaatgtttctgtcgataggaataaatgtttcttacttacaagtccattacagttccctgatgatgatgtcacaagcatacaaagagcaaattactctttggctagaatgctatttgcttcaggtggacatttgtttgatacggaagagtacgttgatacaggttgtattgtaagagaaataatagatgtacttgatatgaatattaaattggataatgatatgatgtacgaatatctcagaaatataataaatagtggtaatgatatttcgctgtatgccatagaagaaatgcagtctgatttggaaagatatttgtttaggtatcagttttgtcaggaaacaattgatatctataattatcatgctgatactggatactttccaccaaatatagagtattatgatgagcattttggtggctctgagagtatggctaatcaatatgtattggggtatcggcaaattctgcaatgatggaaaagagttgtaattatggtatataagattattgatgcttcattccataccaatgataagtgtaaagtctatattatcaatgatccaatagagtttttgaatatagatattacagtattaaaaagggctatgaaaatgatttagtgcaaatatatcccagtgatgttaaaattattctaaaagaatcagtattagagcagttcccttgttttgatattatttaggaaagtttataaagaaatgatagatgatagaacctgttataaaatagaataatatagtttcatttgtgagattatagctagaataaatgatgggaaagaggaaatatatggataagaaaagaactataacatataatgtatatggaggacaaataaatactgctaatgataagtcaacaattcatgctacacagaacaatggggtgactttaagtgaattagataatataataaatggaattacagagaatttatccgcactgaaaaaggaagacgtagatgctattgaagatgttataaatatgataaaagaggaatttgcaaagcctgaaccaaaagtaaatagattaagaaattatttgaatttgattgctccgatgtttacaattgcaaatggcattccagatttatcagaacacttacataggttaattgattatatcaatatgtttatacattaaaattgtaaagaagagaaaaagcaaatgaggaaagatagcaaaatttttttagcaaaggcattggattatgcaaaaaaaataggagatacttcttttgaagtaaatattagttattttaaagatgtaccaaatataagcatttgcattgaagatatattaaaagatttggtagagaataactgtattacaagtcaaagtaaagttaataacttggaaggttatatttcaatatatcttacattagctggatttaaatattttaatgagatagaattaaacgagaataatttacagtatatttttaatgtttttgggggacaggttaatgttgctaatgacaatggacaaattaatattgatgcaaaaaaagaagaaaacataaaagaattaaaaatggaagttttagaattgaaagaaaagaataaagaaagaagttttgccgatattgtagattcttttcgaataaatgataatcgtattaataagctatatttcaaatgtcagtatatgaaattttatggcagagaaagggaactgagtagattagaaaaatttttagatagtgatgaaaatatattgatatatactatctatggtgaacaaggtgttggtaaaagtaaactggcttattcctttattcagcaacaaatagaacaagaatattggaagatgatttttatagatggttcaattttaaaaaaaataaattcatataatgaatattattataaagaaaatcttttgattgttatagataatataagtaaagctccttttgaatttgcggaatggttatcatttattttgcaattatcagattctaatttacctccaaaattaaggcttttattattagataggactggggttattaaggataatgagttcgttgtttttcccgaatggtatcaaatcatattagataattatgttgatttggattatttatctaattttgtttataattttgatgaagattttggcttttttagattgaaaggattaggacgaaaagaaatcataaaaattttagatgattattctcgcctttttattaaagacaataataaaataaaggaagatgattttacaacctatataaagcaaaaatgtgatgatattattatgaatcctatgataatgattatggggttaataaatgaatttacagacgataaatcaatagaagaatatttttttgataataaagattttattgttagaaagatttgtaaatctgataaaaaactttacgatgcgatgcaaaaaataataatatacataaatgttgttggaaggtgggaaattggaaaagaaagcagtttacctgcttattttgcggatgcagcattttacattttaggtaatattgatgagttagaattaaaaaaatttatatgtgcttttaatgaacaaaaagtttttgagggagattggcctgcgattaaaccagatataataagtgaaattgttgttataaaatatttagaaagaaaacttttaaatagaagatttctagaagaattaattaaagaaatagcttctaacaatgtctttgaattgttaacgttttgttctgattgtacacttaatttgaaatctgattactgtaataaaataataaataaaattacagattatttaaaagaaacacaaatttttgaaacaattccaataaatagaatattaatgacaaaccaagatcatttgacgaggttaaagctagtatattatatggaaaaagcaaatatattacctgagaaacaaacaaatggcagaatgatcttcaagagcgaggtgttgagaatgtttttgaagtattcaggtataagtgattattattctgatattaattgcaatacattacaatgtgtatgcttgtttcgagaatgtcaaagaaaattaaatgatatagtaactaatcctatttatttagaaaatgcaattccatatttaaaaagcattggattttcaaatgatttttgtgatatagtaaaaaattcatctatttatatttattcaagtaaaagtgtggaaagttacattgcttctttggttgattttttttcagaagaatttttaaatgataatgatattgatagtatcttgaaagatatacatgaaatacaaacttcagacgaaaaacagaaaaatataaagatgctatttattaattttattatattgatgaaccaaattgaaattgaagctgattttatttagaaattatggagatgcatttaatttgataagactatttattttgcgaatacgatgatgattacactcgtcgtggatatcataattatcgtggtagtataacggagcaggagtttaatgaatgcaaaaagcagattactaaggattggcacctttataatgaacatttatgtaagcgaaaagcagtgtgatacagaaggcgtaattacaaattgagatatttgaaaaaccataagtatatttgttgtatatgtatacttattgtgtatatcaaggatattggtaattatggggagtgtaataactgctcggatgcattcgctccgtgctggtttcgttggaggcacacgtttcgagcctatctatggcattgaggcatttgttccgagcctataatcaaagaggcgttcgttccgtgagggcgatcaggcgaagaaacttgcaaaaatgcaggacgaaaactaatctgtccggtttatgatgttcgttttgctataggtagtagctgataattgaaaaaatggatgaagaagacggacgttgacatatgtcattgtccgtcttttttattttgggtatatagtttagatgcacggtatacccttttttatttggttgtatggatagacctggggatttatttgcagatgcaggattttatggtggagctcgtttacaacttgaataggaaatcaaataaacaataattaagttgaaaaagggtataattagggtataattaggacataagcaagggggtgtatgttatgccacaaataattccaattaaagacttgaagaatacatcggagatatctgatatgtgtcataagacagaggagccaatttatgttacgaaaaatggctatggagatatggtaattatgagcatggagatttatgagtcaaccatgagacagattgctatgtacagagatatagaaatatctgaaaagcagatagaggcaggacagataaaaaacgttaataaaggaagaaaacatgagtaagaaacacaaacatatttctgccacgaaaacaacagaacaaaaggcagtacaacagtcacagcagccacagaaactgacaccacagaagctgaatcagcttttggagaaaaatccgtttgcacagcttctgggaatggaactgctggaagtgcgggaaggctatgcttacggaagaatgcgcatggatgagcattttacgaatatttacggtggaatgcatggcggatgtgcgtatgcgcttgctgatacgcttgctggtttggcggcatccacctatggcaattatgttacaacgattgatgggaaaatgaattatctggaggctgtgaaagataccggctatgtgtacggtgaggcagaagtacaaagacagggaggacggatcggcgtatataccgtgaaactcatggatgaaaatcaaaaagttctggttacagccgattttacctattaccggacaggacaggcgattgaccagcagggatagggtgttttcaaggtgtctgatttggaaaaaattagatgccttttttctttttacttgtttatcgcgttaaagtgtagtagtgttaaaatataaaaataccaaggaggaaaagttatggggaaaggaagacgggaaaaggttttggacagcatcggaacattgcagcagacggtgaatgaatttcaaatataaattgtttgtaaaataaaaacaacttaataaaaacagaaaatgcggtcatatttatgaaaaaatatttcatgaatatgaccactttattgtttgaaaaacggttaatataaaagaaaaaacaagatattatctgacaatactgcgataaataaataatagacaaattatcagacaaaagaacgaaaaaagtgatttacaagcggcgattataggagtaaaatgagaatcagttaagaaaaagcaactcatgaatgatttacaacgaaaggatagttctatgaaagagcaatggaatgagagcacagcaaccgccaaaggattatatgatccgagtttcgaacatgataactgcggaattggtgctgtggtaaacatcaaagggatcaagacccaccagaccgtggaaaatgccttgaaaattgttgagaacttaaagcatagagccggaaaagatgccgacggaaagaccggagatggtgttggtattcttcttcagatttcccataagttctttaagaaagcgacagagccgcttggaatcgagctgggagaagagagagattacggcgtcggaatgtttttcttcccacaggatgagttaaagaccaatcaggcaaagaagatgtttgaggtaattgtcgagaaggaaggaatggaattcctcggatggagacaggtaccgattcatccggacaagctttccgacaaggcaagaggatgtatgccatgcatcatgcaggcgttcatcaaaagaccggaagatgtggagaagggacttgattttgaccgcaagctgtatgtggcacgccgtgtattcgagcagtccaacgatgacagctacgttgcttctctttcgagcagaacgatcgtatataaaggaatgttccttgtagagcagctgcgtcagttcttctccgatctgcaggataaggattatgagtctgcaattgcaaccgtacattcccgtttctctaccaacacaaatccaagctgggagagagcacatccaaaccgttttattgtacataacggtgagatcaacaccatccgcggtaatgcagacaagatgcttgcccgggaagagacgatggcatccggcaagctgcgcggggaattccagaaggtacttccggtcgtcaacaccgaaggatctgactccgcaatgctggacaatacgttggagtttctggtgatgagtggcatggatctgccactggcagtcatgatcatgattccggagccatgggcaaacaacgctgtgatgacacagaaaaagaaagatttctatcagtattatgcaactatgatggagccttgggacgggcctgcatccatcctgttctccgatggagatatgatgggagcggttcttgaccgtaacggtctgcgtccatcccgttattacattacagacgatgactatctgattctttcttccgaggtcggagttcttgatattgatccgacccatatcgtgacaaaagaccgtctgcgtcctggtaaaatgcttcttgtagatactgtgcagggccgtgtgattgatgacgatgagttaaaagaaagatatgcggataagcgtccgtatggtgagtggcttgacagcaacatcgtcatgttaaaggatttaaaaatcccgaatgagcgtgtgccggaatacacacaggaagaacgtcagagaatgcaaagggcattcggttacacgtatgagtccttaaaggattccatcctgccgatggcaaagaatggcattgagggtaccgctgcgatgggtacagatacaccgcttgcggcactgtccggaaaccgtgagccgctgtttaactatttcaagcagctgtttgcacaggtaaccaacccgccaatcgattctatccgtgaggaagttgttacttctacgacggtgtatatcggatctgccggaaacctcttagaggaaaagccggagaactgtaaagtacttcggatcaacaatccgattctgactaacacagacctgatgaaaatccgcaatatgaaagtagacggatttaaggtagaaaccattccgattatttattataagaataccagtcttgagaaagccgtagatcgtctctttattgaggcggaccgtgcatacagagacggagccaatatcctgatcctttccgacagaggagtggatgataaccatgtggcaattccttccctgcttgccgtatctgcattgcagcagtatctggtaaagacaaagaaacgtacttccctttccctgattctcgaatccggagagccgcgtgaggtacatcattttgcaacactgcttggttttggtgcgagtgcaattaacccatacctggcactggataccgtaaaacagctgatcgatgagcacatgttggacaaagattattatgccgcagttgatgattataaccatgcaattatcaccggtattgtaaagattgcagccaagatgggtatttctacgatccagtcgtatcagggttccaagatttttgaggcacttggtattgataaagatgtcattgacaagtattttaccaatacggtcagccgtatcggcggaatttccatcaaggatatcgaaaacgatgtcaatacgcttcattctgcagcctatgatccgctgggacttgaaaccgatgtaactcttgacagcaaaggccgccacaagatgagaagcggagccgatgcgcatctgtacaatccggctaccatccatctgctgcagcagtctaccaaacgtggggactatgagatgttcaaacagtatacgagtctggtagatgaagaagaaaagcatacgaacctgcgtggactgatggattttgagtacccgaagaagggtgtgaagcttgaggaagtggaaagcgtagattctattgtgacacgttttaagaccggagcgatgtcttacggttctatttcgaaggaagcacatgagacacttgccattgccatgaatcacttacacggtaagtcaaacaccggtgaaggtggtgaggacaaggatcgtctgaccgtcggaccggacggaaagaaccgttgttccgcaatcaaacaggttgcatccggacgtttcggtgttaccagccgttatctgaccagtgcgcaggagatccagatcaaaatggcacagggagcaaagcctggtgaaggtggacatcttccgggtaagaaagtatatccatggattgccaggacaagactttccacaccgggtgtatctttgatctccccgccaccacaccacgatatttattccatcgaggatcttgaacagctgatctttgacttaaagaatgcaaaccgcgatgcaagaatttccgtaaaactggtttccgaggcaggtgtcggtaccgtagcagccggtgttgcaaaagccggtgcacaggttgtcctgatctccggatatgacggtggtacaggtgctgcgccaagcagttccatccacaacgcaggtcttccgtgggaacttggtctggcagagacacatcagacactgattatgaacggactgcgtaataaagtaagaattgagacagatggaaagctgatgagtggtaaagacgtggccattgctgcatgtcttggcgcggaagagtttggttttgcaaccgctcccctggtaaccatgggctgtgtcatgatgcgtgtatgtaatctggatacctgtccggcaggtattgcaacccagaatccggagcttcgtaagcgtttcgcaggaaaaccggagtatgttgagaacttcatgcgctttatcgcagaagaacttcgggagtacatggcaaaacttggtgtccgcacagtggatgaactcgttggacgaagcgatttcttaaaggttcgcggagatctgtccgagcgtgaagcaaagcttgacctgagcaatatcttaaataatccgtttgcaggaacaaagcagaaggttatttttgatccgaagcaggtatatgatttcgaactggataagaccaaagatatcacggagttcttaaaacagttaaagccggcacttgataagaagcagaagcgtatgatcgataccgaagtaacaaacgtaaaccgttcgcttggaacaatcttcggatcagagattacaaagaagtacgacgatacactcgatgaggatactttcattattaaatgcagcggagccggcggacagagttttggtgcctttattccaaagggactgacactcgaactggtgggagattccaacgattatttcggaaagggactttccggcggaaagctgatcgtttatccaccggcaggagtaaacttcaaaaaggatgagaacatcattatcggtaacgtagcactgtacggtgcgacaagcggtaaggcattcatcaatggtgtggcaggagaacgtttctgtgtcagaaattccggagctactgctgttgttgagggtgtcggcgatcatggatgtgagtatatgacgggcggtcgtgtcgttatccttggtaaaaccggaaagaactttgccgcaggtatgagcggtggtattgcttatgtattagatgaggacaacgatctgtacatgcgtaccaacaagtctatggtattcagtgaggaagtcaccaataaatatgacgtattagagctcaaagaaatgatcaaagaacatgttaccctgaccaattcggaaaaaggtaaggaaattctcgatcacttcagtgagtatctgccgaagtttaagaaagtcatcccatatgattataaccgtatgcagatggcaatcgttcagatggaagaaaaaggtttgaatgcagagcaggcacagattgaggcattttatgccagcacgagagcataaggagggaagaaacaatgggaaagccaacaggatttatggaatacgacagatgtgaggcgcgttcggtggaaccaaaggaacgaatcaaaaattttgatgaattccacatcttcctttccaaagaaaaacaaagagagcaggcagcgcgctgtatggattgcggtgtcccgttctgtcagtcgggtatgacagttgccggaatgacttccggctgtccgctgcacaatctggtaccggagtggaacgatctgctttataccggaaactatcagcaggcatataaccgtctgcacaagaccaataatttcccggagtttacctcccgtgtatgtccggctctgtgtgagaaggcatgtacctgtggacactggggagatccggtatctgtccgggacaatgagcatggaatcattgagacggcatacaaagaaggttatgccggaccacatattccaaaggttcgtaccggaaagaaagttgccatcatcggttccggtccttccggactggcagcagcagaccagctgaaccagagaggacatgatgttacggtatatgagagagatgaccgtgtcggcggacttctgatgtatggcattccgaatatgaagctcgaaaagcagatcattgaccgtaagatcaatgttatgaaagaagagggcgtgaagtttatcacaggctgtaatgtcggtgtggatgttaagagtgcagagctgttaaaagagtatgacagagtcatcctctgctgtggagcaaagcatgcgcgtgatatcaaggcagcaggtcgtgatgcagaaggaatctattttgcagtcgattatctgtcacgcaacacaaagagccttttggattccaattttaaggacaacaaatttatttccgcaaagggaaaaaatgttgtgatcatcggtggcggtgataccggaaatgactgtgtgggaacggctatccgtcagggtgcaaagtctgtaacccagctggagatgatgccatgtccaccggcagagcgggcagcaaataacccatggccggagtggccgaaggtgttaaagaccgactatggccaggaagaagcgattgcatgtttcggtacagatccacgaatctatcagacaaccgtaaaggaattccataaggataagaacggcaagttgaatggtctgacaatcgtcagacttgagagcaaggtggatgagaagaccggacgcagaaatatggtggaagtttctggttccgagaagaagattccggcagaacttgtactgatcgctgcaggattccttggaacagaggaatacattgcaaaggcattcggtgtagagctgaaccagagaacaaatgtagctacagagcctggaacatatgcaacaaatgtaaagaacgtatttgttgcgggagatatgcacagaggacagtcactggttgtctgggcaattcgtgagggccgtgaggtggcacatgacgtggatacaagtctgatgggatattcttatctgtccgtacagtaaaatagagacttatggctggtgcatagccatatgatttttgggagtcatctgaaacagatggctccttttttacctcttgtgggcttcacgcagttattcttatttttatcgcagtatatctggtggcaagcaaaatgcacatgatactttgaacacagcaatgcaggcggacatgtggaatgtaaaggtcagggcagcagtgatccggatgctccgtgtgtggaactgcagatctcaagcagttttggacaggcttgtataatttttggataattctgcttgatattatgtacatttcgatgtagaattatagataaatagtatacgatacataggaggaaacgtatgcgtaagaattactttcaaaatgtgaaaattgcggataagctgaaaatggttatgaaagcaatttttgcaattttactggtgaacaatattctgtttgcaattttaatgcttgtatttggacatccggtatggattatcattcctgtcattgcagtagttggtatgccattgctttccaaaatgatcattcaggaactgacagaaaatattcttgaaccgttagaccagatagaaaaggccgcagatgacatggcacacggaaatctcgaaattgatatttcttatcagggggaagatgaactgggaaagcttgcagaaagtttccgcaatacatctttttatttaaggggtgttgtggacgatatcaatcagctccttacagagtttgcaaaaggaaactttgatgcgagatcccatgatattgaagcctatcagggaaatttcggtgaaattttaaagaaactggaagcgacagaaaataatctgagccagacgatcaaaaatgtacaggaatcttccaatcaggtatccgcaggagctgaccagctggcacagagtgcgcagggactggcagagggagctaccgatcaggcagcggcagtacagcagctgacatcttcggttgccgaggttgctacacatatcgaagaaaatacgaagtctacagacagtgtacatgaccaggcaaagcgggttgcaatcaaggcagacagcggaagtgcaaagatgaaagaactggtcgaagccatgcagcatatttcagagaccaccaatgatatccaggttgtcatcggaaagattgaaagcattgccagccagacaaacctgttgtctttaaatgcatccattgaggctgcgcgtgccggtgaagcaggaaaaggatttgcggttgttgcagaacagattaaaaaccttgcggaagagagtgcttcttcggcagaagaaacccgtgtcatgctgacaaacagtctgaatcaggtgggtgtcggaagctctgttgcagatgagacttcccagtttatgtcggaaatgatcgaacagctggatgcggttgttatggaggtggctaagatccgtcagatttctgatcagcaggcagaatcggtaaagcagatttccgctgctgttgagcaggtaaacggggttgtgcagtctaattctgctacttctgaagaagtatctgcaaccagtgaagaactttctgcatctgctgaaagtctggatgagatggtatctgattttgttcttcgtaaataagatacgaacagatgactggcacattgtacagatgaggtgattttatgccgtcgatcatggtgtatacggaagaaacattttattatacagacggaatccgtgttgttgcgcgggaagaatatatgcggccggatgttacggaactgagtttctaccagaaagaaggtttctggtttggatttgaagctccgtattctatttataccatgcagggaatccgggcattgattgagttgaaactcagacaatacgattgtacaccggaatttcgctatacgcgtaagaaaattgaatatagttacagtgaaaaaaagattctcgattccgtgattttttatatcacgaaatccgatcagccgggagttttgtctgtgatggaggaaattaatcattccactcatctgtgtttctggaacatgaaagtgccataccatgattttggggaaatccgtaaacataccgatgcggtattttacggaatgtttcaacaaaaagcgtaatagttcttgactttttcggcaaaagttctataatacattctcggtaatagaggatgtgtcgaatgaataaagagagagattatttttttgataatttgaaagcggtattgatattcttagtcgtgctgggacattttttgctccctatccacggagaaagtgttcttgtggtggtaaagcgcctgatctatgtatttcatatgccgctttttgtatttgtgtcaggttattttgcaaagaaaatatataaaaacgggcagtataattttaaaaaaatattgtatctgatcaaggcgtacatcatatttgttattgcaattcagatagtatatgcactgtgtggattccgggatttctcagagattaattttttctcgcagagtggggcgccgtggtatctgtttgccatgattgtgtggtatcttaccattcctgtcatccggaagtacaaagagataccggtattaatcgtgacggttgcgctggccctgatcgccggatatttcaaaaatatcggcgattttttgtgcatgtcccgtattctggtatttggtccgttcttttatctgggatattatatggaacaaccggtgcttgaacgggcattgcgaccggtttaccggagagttgttgtaccggctgctgtggcaatctgtgcggggattctggcgtttggctcaaagttaaaagatgagcttggcatggtctatgaaaacatttcctattatgaactggatgatgtgtgggaaggaccgtttgtccgtctggcactgatgattgccgcgtttctgatttcgtgggcgattatgttttttgtgccgcgtgggaaaacctgtctgtcagtgattggacagaatacgatgccggtatatatgctgcaccggatcctgcgggatatcctgatgtttgcgggaatctatgactatctcggagactggggatggtttgcgctgtttgttctgatttgtctgagtatctgcgtgatttacctgcttgttaatccaaaggtagtaaatcaggtaaataagattctgacactgtataccccgcggctgtggggcagaatacgccggaatcaggcgatataaaggaatcgtagattgacgtttcctcctatattttctaagcttagaaccagaaagatataggaggaatttttttatggatgcaaaaaagtttggagtactctggtattatggagaaatgtctgcacggatacttaatggtgtaacggcacagcgtatgatagaagtaattcgtatttgacaattccaaaaaatgattatatagtggcagaaaagaacttttgttttcacagagaaaatacactgagggaggaacgtaataatgtatgaatttacgcaggattgtctgacgggcatcgaccagatcgatgaagagcaccgaaaactgttttcgctgatcaatgaagcggttgaactgccgaaagaagcacgcacaccacagacggtaaaaaatatactggaacatttaagtgattatgccgtaaaccattttgcacacgaagaagcctatatggaggcacagaacgatccggaactgccgttgcagaaaaaagagcatcaggcatttgccgatcacgtaaaacttctggaaaagcagccactcaccggggagaatgcatcggcgatgctcgatgagattctgacctatctggtacgctggctgtaccggcatattttaagcagtgacatgatgatcggaaaaatgcagaaagaagatccgtttgtgtttaccgcgaaatattatacgggaattgaactggtagacagggaacaccggaagctgtttgagattatcggagaggtaaatgcactgatccataacgacctgcttcatgacaaatacgatgaaattgtacgtctgctggatgaactccgggaatataccaagtttcattttgaagatgaagaggcctatatgcagaaaatcaacagcccgatgcttgaagcgcaaaagagggcgcatcaggcatttgtggacaagctgatgagtatcgatctggataagctggaagaaattgatgacaaccagcaggaatatctgcatgagctgatcgagttcctcggcggatggctgatcaatcatattttaaagatggatacgcagattgaaaagacagagcagtaagtattatgtgcggtgaaaggattattttcgccgcattttaatatgtcaatttaatatgaaacttatatagaaaatacgttatcctttttaaaaatattctttataataaaagatagcgagattgagaaaaggaagtgtatttttatggcaacaatttttccaagggaacagaaggcaaaaatgctttttgaaaagattaaagagaatccgcaggcatgtgagcgcctgatggaaacgttttatgatgcgctcggagtgggcgatgattatgagggcaacggtctttctgcggagcagttcgcaaccgcactgtttcgttcttatgaggaaaaggatctgacggcgtttctgatggcaatctgccagaacagtatgtttgatctgctgcggaattcgtttctggctccgtttcgttttaatgccaatggtcagacaaatccctatatcctgacggatgaggatggaaaattaattccggatatcaaatttcatgtcagtgacaaaaattatgagcagttttttaaggtatttcaaaagagtgaacaggtgaagatgtatctggcatacggattccgtaaacggcattgttatgacagagataccatggaagcacaggaaatccgtatgggagagcatatcggagtgctgcttgtctatgaaatgccggatacggtaaaaatgcaggagacagaagcgcaggcatatgcggccatctgggatatcctgatggatctgcagaaatccctgccacgttcggtcgtttattacggacaggattccatggaaaataagggaaaccgttacgatgcacttggggtgtttttgccgatgtaccattttcggaaggcattggagaaaaacattgatattgcaaacaaaattgtattgatgcattaagaaagaggatgatgattcatgcaaaccactgcaatacctaaaaatcacatggatatcccatggcatgagtacagcggccacggaaattgtccgattacagaggcagacctgaccgaaaaagcttcaatcgtcggccgtgtcggcctgatgctgttatcctgtggaacgggagcctggcgtgtccgcagttccatgaatacgatttcacaaaatctcggaattacatgttcgacagatatcggtctgatgtcgattgaatatacctgttttgatggaacaagtggattttcccagtctctttgcctgaccaataccggagtcaacacatcaaaactgaaccggctggagcgttttatcggtgaattttcaaccgtagggaaaaccatgacgggcgaacagctccatgatcatctggatgagatcgaccggattcatggactctattccccggtggctttgggatttgccgcggcactggcatgcggcgcattcacatttttgcttggcggaggacccgtggaaatgctgtttgctttttgcggggcaggacttggaaactttgtccgctgcaaactgacaaagcatcatctgacactgtttctcgggattgtggcatccgttgcctcggcgtgcgttacctataccattctgcttcggatcgcagagctgattgccggggtttccctgcagcatgaggcgggatatatctgttccatgctttttatcattccgggctttccgtttattacaagcggaattgaccttgccaagctggatatgcgttccgggctggagaggctgacctatgcgatcattatcattgttgttgcgaccattacggcatggctgatggcactgcttttgcatctgcatccggtggattttccggcgctttccatgtccgttcccatgcatatcatactgcgtctggtcttcagtttctgcggcgtgttcggattttcgattatgtttaacagtccgtggaaactggcggcaacggcagcactgatcggagcagtggccaacaccctccggctggagctggtggatcttgcttcatttcctccggctgcggcggcttttgtgggagcacttttggcaggaatccttgcatcattgatcaaaaaccaggcgggatatccaaggatttcacttacggttccgtcgattgtcattatggtaccgggactgtatctgtaccgggcaatttacaatctgggtgcgatgtctttgaatacctctgcatcctggtttgcttctgcaattttaattattgtggcactgccgcttggtctgatctttgcaagaattctgaccgaccggacattccggtattgtacatagaaatacgtctgtttccttacggctccacaaatcccggaaagatactgacacctctttattttagaaaagacttgcaaaaacagaccaattgaagtaagataagatacacaaaacaggatgtctgaaaaagactatagattttacggtttctgattcaaaccgtcggtctatagtctttttttgcggaacatccggcagaaaagaggagtttgtatgaatcaggagtacatgaaaacaagaaaaatcctgccgctggtgctttccatgtcacttcccatggtcatatccatggcagtgaatgcattgtataacattgtggacagttattttgtggcaaagatcagtgaagatgcgatgacggcgcttgcccttgtgtttccgatgcaaaatctcgtcaatgccattgttatcggatttgcgatcggaatcaatgcaagggtagccttttatctgggagcaaaagaagagaaaatggcggatgagtcggcatccgtggggcttttgttaaatttgatccacggtctggtgctggcactgctttgttctgccattatgccatcgtttcttcggatgtttacaggcgatacacaggtgatcgcactggcatgcacgtattccacgcgggtatttgcgtttgcaccagtgatcggtctgggacttgcatatgaaaagatctttcaggcagtcgggcggatgaaggtgtcgatgatctgtatgatgctcggatgtgtaaccaatattattttagatccggttatgatctttggtctgggaccggtaccgaagcttggaattgcgggtgcggcttatgccacgggaatcggtcagtgtgtgacgctggcggggtatctgctgttttattttgtacgtccgatgcatgtaaaggtcaacgtcgcaaatatgaagacaaccggaagcgtaatgaaaaatatttataccatcggaattccggcaactttaaatcttgcacttccttccattcaggtgtccgcattaaatgcaatccttgcgccgtttccgggaagttatattctggtgctcggagtttattataaactgcagacatttatttatctgacggcaaacggaattgtgcagggaatccggccgctcgttggatataattatggagcgggagaatatgacagggtgaaaaagattacgcacacctccatgggattgatcgcactggttatggttatgggaatggcaatttcctgtgcaattccgcagcagctgatgggattgtttaccacaagccgcgcaacaatggaaatcggaggtgcggcactcagaatcatcagttttggattcgtggtatcctcggtttccgttacattttccggagtcctggagggactgggaaagggcatgccatcacttttgatttctcttgcgcgctatatcgttgtgatgctgccggtttcttttgtgctcagccggttgttacaggcatcgggtgtgtggtacggatttgccgttaccgagtatatcgtagcggttctttcctattatatatacaaattccatatgagagatataaaagggtaacaaaataaaaaaagtgtggtacaatagttaaaatatggataagagaaaaggaataaggaggagtcggttatgccatactcaaacgccaccaaacaggcatttgcagatgctcttcgaaaactgttggaacagaaaccttttgcgaagatcagtgtatcacacatttgcgaagaatgcggaatgaaccgcaaaagtttttattatcattttaaagataaatatgatctggtcaactggatttttgacactgaaattacaaagattttttcagaagaagaatggaaaaatgccggctttacatgggatatactggaaaaaatctgtgagtatttttataaacaccggacattctattcgaaagtactgcagattgaggggcagaactcttttacagaacatttccgggatattttagtccctgtcaatcgtaaatttcttgcgatggtagaggaagaggaaaaaggagagcacgacgaattttatattcatttcttttcggatgcatttctggcagcactggtgagatggcttgaggacagggaatgtgtgtccccgcaggaattcagtgcactgttgcgttcgagtgtggaaatgattgcaaagtatgtgctgcacagtcagaaataagggcagaagtattctgtaatctggaaaaattcgacaaattttacccacattcgtgcatttgtccacttgaatttaagaagagaaaagatataatacttttcagattacacaaaaacatttctgtcatgttatggcgacagaatgaaaggaagttgagattatgaataaaatgtcattacagaagagtattcagaactttggaatcaagcaggccttaaagtatatggagaaagatccggaggagaatattccgaaactgatggatatggttgacaaatttgcaccggacggatggtatgaggcacagagaaatatgatccgcaaggtgattcaggagaggggaaactggtaccagctgattcttcgcatttatcagctgaatccggaagtccgtaaggcattcttccagaatttcattttcaatgcaagcttaaaaggcagcgcactgcaggagcagcttgctgaagaaaacaactgtaacattccgtgggcaattctgttagaccctacctctgcatgtaatttacactgtaccggatgctgggcagcagagtatggccatcagctgaatctggatctggatacgattgattctatcgtacgtcagggtaaggagcttggtacctatatgtatatttatacaggtggagaaccattggtacgtaaaaaagacctgatcaagatctgtgagatgcatccggattgtgaattcctttctttcacaaacggtactttgattgatgaagagttctgccaggaaatgcttcgtgtcaagaactttgttccggcgatcagtctggaaggattcgagacagccaacgatggacgaagaggcgaaggtgtatttgataaagtacagcatgccatgagcctgttaaagagccatggtttaccatttggtatttccacctgctataccagaaagaatttagatgatgtaaccagcgaaaaattctttgatatgctggttgagagtggtgcattatttgtatggttcttccactatatgccggttggaaatgatgcagcagtggaacttctgcctacacctgagcagcgtgaggaaattttccatcgtatccgtaagttccgtcagacaaaggcaatatttagcatggatttccagaatgacgcacagtttgtcggtggatgtatcgccggtggacggagatacttacatatcaatgcaaagggtgatgtggagccatgcgtatttattcattattccaatgcaaatattcatgactgcagcctgctggatgctttaaagagcccgttattccaggcatatcatgacaaccagccgtttaatgacaatatgcttcgtccgtgtccgatgcttgagaacccggataagcttggagagatggtaaaggagtcaaaggcagtaaataccgattatcagtcaccggagacaccggaacatctgaaagaaaaggctgctccttatgccgagaactggacacctacagcagaaaaactctggaacaaagaaaaagaaaagattgcagcaggaaaagccggcgtggaacagtaatgataagttttctcaataaggacagccggattgttgttgcataaagtgtgggactccgctatttatcggatgatagatggtgtgagtcctttttttatgctcttttttgcacgccgtggtgactaaaaaaatacttgcaaattggaaaaatggggcataaaatacgtttttaaacaggaaaacaaaattataaatcagttactaaggaggaaacaacgatgttaaagtgtttcaaaaattttgatgcaaagaaaaccggactttttgcagcaggtgtactgttcggtaccgcaggaatcaagattctttccagcaaggatgcaaagaaactttatacaaattgtacagcagccgtactccgtgcaaaggaagttgttttaaagaccgctacaaaggtacaggagaatgcagaggatatctatgcagaggctaagcagatcaacgaagaccgtgcagcaaaagaagaggaagtatttgacggtgaggaagtaaccgaagagacaactgccgaagagacagaaactacagaagagacagcagaggcataaaaacgcatgaaagagatgttaccttatatgtaacatctcttttatcgaaagcaggttatagatatgaaatttcaaatcagacatgagataagaggaagaatgaggattcatgtgatccagagtcgtatgtcatttgcacaggcagatacattacagtattatctggaacagtgtgaatctgtgatttccgcaaaaattcaaaatcgtaccgaagatgtgaccatttgttatgaaggaagcagagatgcaatccttgaagtgttaaaggcattttcgtatgaaaagacggatgttccggatacctatattaaaaattccggaagagaaatgaatcagcattactgggatcagctggtggagcagacgttctggcatttcggtaacaaactgtttctgccgttttccgttcgtgcagtaatcacaacggtgaaatccgtgaagtatatctggaaagggcttcagactctgtttcagggtaagatcgaggttccggtactggatgcaactgccattggtgtttccattatccgtggtgattttgcgaccgcaggatctgtgatgtatctgcttggtatcggagagacgctggaagaatggacacataagaaatccgtgggagatctggcacgcagtatgtcactcaacatcagcaaggtatggatgatgtgtgatggacaggaagtactcgtttccgcagacaacgtgcagtccggagatgaagtgcgcattcatatgggaaatgtgatcccgtttgacggaacggtaacggatggagaggcaatggtaaatcaggcatctttaaccggagaatcggttccggtccgcaaagtacctgatggcgtggtatatgccggaactgttgtcgaggaaggcgagattacgatccgcgtcagagaagcaaacggatcaagcaagtatgaaaagatcatggcgatgatcgaggaatcagagaaactgaaatcctcactggaaggaaaagccgaacatttagcagataaactggtgccatataccttcctgggaacagggcttgtatggctgtttaccagaaacgtgacaaaagcaatttctgtgttaatggtggacttctcctgtgcattgaaacttgcgatgccattgtctgtgctctctgcaatccgggaagcaagtacctataacattaccgtaaagggaggcaagtatctggaagctatggcggaagcggataccatcgtctttgataagactggtacactgaccaaggcacagccgacagtggcaaagattgtttccttcaatgatcagtccgaggatgaactgcttcgtattgctgcctgtttagaggaacattttccacattccatggcaaaggctgtggtacgtgaggcagtaaaccggaatctggtacatgaggaacttcactcaaaggtagagtacattgtcgcacacggtatttcttccaagatcggggagaaacatattgtgatcggaagctatcatttcgtatttgaggatgagaatgctacaattccggagggaaagaaagagatatttgagcagcttccggagcagtattcccacctgtatatggcgattgacggagtgcttgtggcagtgatctgcatcgaagatccacttcgtctggaagcggttgaggttattgcaaagttaaagaaactcggaatctccaaggttgttatgatgaccggagacagcgaccgcgtggcatctgtgattgcgaaaaaagtcggtgtggatgagtatcattccgaggtattgccggaagataaagcaagctttgttgaggcagaaaagaatgccggaagaaaggtgatcatggtcggtgacggtatcaatgattctccggcattgtctgcagcggatgtcggcattgccatcagtgatggtgcacagatcgcacgcgagattgcagatgtgacggtgggtgcagatgatctccatgagctcgttaccttaaagaagatcagtaatgggctgatggagcggattcacagaaattaccgtctgatcgtaggaattaacacctcattgatcgttcttggtgtggcaggggtatttccaccgaccacatcggcattgcttcacaacacgtccacacttctgatcagcttaaagagcatgaacaatctgctcgatgagaaggaagaagtaacagaagaaaatgtagcagaagcatttgcataatggaaacaaaactgtctgattctcataaaataaaaagaatgagaataaggcaggaacaaaatgaaagaattatatcctggggatcagggaatctgggtacaatatctgcagctggcattgcagcgtgcaggacagcaggtgatgctggatggaatttttggaccaaagacctgtgcagccgtggaaaaagtaatgggcagcagcggaaagtgtgcggtaaaagaagcacagtggaaccgtctactgccctttttacgtgggtatatcacacacgaggtaaaagcaggagatacttttttctccattgcgaaaatgtatgatacaacgatggagcgagtgatgcatgcaaatcccggaacggatgccggagcattacagattggaagtacggttgttgtaccatttaattttccgctggtttccggagaagttccatacacttccctgcttaccgggtggatcatcgagggcttgcaggcacgttatccctatctgcaggtgggaacgatcggaagaagtgttatgggaacacccctgtggtcgctgcagttgggaaatggtccggtagaggtggggtacaatgcttcctttcatgccaatgagagcattaccacaccggtacttttaaagtttgtggagcggctgttagaggcatatgcagacgaacgtatgtatgaagaactgtacccggagcggctgtttgaagaatattccctgtatcttgtaccattggttaatccggatggtgtggatctggtaaatgggcttttgacggaaggattttattatcgccgtgcggtccgcattgcgtccggattcccggatattccgtttccggacggatggaaggcaaatatccagggtgtggatctgaatctgcagtttccggcaggatgggatatggcaaagaaaataaaatttgaacaggggtataaccgtccggcaccgagggattacgtgggacagacaccgctcagcgtcccggagagtattgccatgtttgattttacgagaaaccatgatttttccctgattcttgcatatcacacacagggagaagtgatttactggaagtatctggatgaggaaccggaaggcgcccgccgcattgcggaatattttgcaaaagtgagcggttaccggatcgaggaaacaccggcggcgtccgggtatgccggatacaaagactggtttatcaatttttatgaccgtccgggatataccatcgaggcggggctgggagaaaatccgctgccgatggagcagttttcgaaaatttataaagacaatgtgggaatcctgcttggaggaatgacggaacttgaataaaaaatgaggattacctctggtaatcctcataaatttttttgatgtgattgtagatcctgcttccgatggaagtatcaaatgttttgaccagtgcgttgtttaatgcaagtttattctcggattcctccaccgctttatagatggatgtgtatttgccggcaggaagtttttcgtcttttaattccgttcgtatttttttgcggatcgcttccggaagttttttcttttccggcttctttttttccgtaatttcttttgcatctttttttgattctttggaaacgtgatccgattttttcttctttttctttgtggaggttcccttttttaaagaaacatcctttggggtggaaggggaagcaatgcttggctggcggaaggcttcgatgtttcttccgcgccagaaatcgacaatactgtcaaacccggtatcctggctgatgatgtaaaccggacctttttcccctttcccgatcaggaatccaagataggtggccagctggaaatccagataatttttagctaccttgtgtgtttcaatatattcgatcgccgctttggacgccatcatttcgacatgtgtttcaaaagggatggacttgatgctgtctccgtaaaaaatgacaacacggtcagatgcagagagtttttggatgtctgttacgccatcgttgtgtacattttcatagtctacaagataaatgcccataggtattgttcctcttttccttaatatgtatccattatacgtcaaatgaaaaagaatggcaagagaagggaatacggcaaagaaatagggggattgtacgcagggaaagttggaaacaggaagggggattttttaaaaagggaaatatggttgacggaaatgtggtaaaagattatacttaataaataacaagttttgaatttttgagcaaaatatataaaaccgaacggttttaagggaaggagaataaagttatgaagaacatgaaggtaaggaccaagctgaatctgattctggttctggtcattttacttgtggctctcgggggtactgtttccgtcaaagacatggaagaagtgaaagacaaagcactggaaacgatggaagcatcgtcccgccagagttatgatgattcgatcaaagagcaggtggaggtggttatttccctgttgtcggagatcaatgacgcatataaagcgggaacttatacgctggatgaagcaaaaaaaattgcagcagatgaagtccggcagatgcgttacggagaggccggttacttctggattgaccagtcagatggtacaaatgtggttctgcttggcagtgataccgagggaacaaaccgtatggaaaccaaggatgcaaaaggataccagatggtgaaagaaatcatacgtgtagcagtggaagacggtggaggatacacagattttgtattcccgaaaccaggagagacaaaaccttccccgaagcgttcctacagtgagtactttgaaccgtttgactgggtggtcggtaccggaaattatacggattatattgatactgccattgcaaagcagaacaaggtattttccaactatgcaatgcaaaaggcaatcgccctgatcgcggtatgtattgtgatgcttgcggttgttgcagtacttgtttttatgatcgcacaggatattacaaagtcgttaaagaaagttgtcgcagagattgaagtgattgcaggcggaaattttgcccgaaagatgcagacgaatatgatgaagcggaaggatgatttcggacagctggcaggaacactcgagacgatgcgggaatcggtatgcggattgcttgcacaggtaaagaaggaagctgcaaatattgataacgttgtggaatcaatggataccaatatatcaaatctgaatggggaaattgaggatgtgtctgcaacgaccgagcagcttgctgcaagtaccgaggagacggcggcatcggcagagcagatcaacagcatgacccagcagattgacggagcggcaaaagagattgccgtacgtgcacaggacggagctacagaagcagaagaaatccataagcgggcaacgcagacaaaagaaacaacggtagagaaccggaagaaagttcaggaaatgcttggagaaatcagggaaagactcgaaaaggcactcgaagacgcaaaggttgtggaacagatcggtgtgcttgcagattccattctcgcgattaccggacagaccaatctgcttgcactgaatgcatccattgaggcagcacgcgcgggcgaggcaggaaagggatttgcagttgttgcagaggaaatccgggtactggcagaacagtccaaagatgccgtggcaaatattcaggctgtgacggaaaacgtggataatgcagtaggaaatctgaccaaagattccaaccgtctgctgaattttgtggatacagatattgtgaagagttttgatgaatttgagaagatggcagatgattataacatggatgcctctaaaatcaacgatctggtgtcggatttcagtgcaacttccgaagaactggtagcatctatttccaatattacagaggcgattgacggaattacctcggcatcgaatgacagtgctgctggcacaacgaacattgcacagaagaccgtttccattgcaaacggatcggcagaagtcatgaaaggcgcaaagacagcggaagcttctgcgggagaacttcgcaggaatgtaagcaactttgtgatcgaagaataagaaacataaaaagaatactttataaaatacggggaaagtggttcatgaactgcttccccgtatttttatctgttcacaaaatgaacacagagtttacattttttacacacgtaaaagcgatacactgtttccgtaaagggcattttgttgtccaaaaaagaaaaggagcatttcgctgtgattgagatcaataatcttgtaaaaaaatacggggatcatacggctgtcgatcatctgtcactcgttgtggaaccggggaaaatttatggttttctgggtccaaacggtgctggcaaatcaacaacgatgaatatgataaccggatatctcggtgcgacaagcggagagattaaaattaacgggcatgacattttaaaggagccggagaaagcaaagaaatgtatcggttatctgccggaacttccaccactgtacatggatatgacggtaaaggagtacctgtgttttgtggcagatttaaaacagctggaaaaaagtctgcgcagacggtatgtggaagaggcaatggaaacgaccggtacgacagaagtggcagggcgcatgatccgcaatctgtccaaaggataccggcagcgtgtcgggtttgcacaggcgatcctagggtatccggagattatcatactcgatgagcctacggtcggactggacccgaaacagatcatagagatccgtgaactgatccgtcatctgggcgaaaaacatacggtgattttaagttcccatattttgccggaaatttctgccgtgtgtgaccatgtgtttattatttccaaaggaaagcttgtagcgagcgactctacggaaaatctggtaaatctgatgtcgggtgcgcaagagattgaactgacggtgcggaccggtgccggggaagcagccggatacttacagggagaagaaaacattgcaagggtggagcaggcggatcatgataaaatccgtatttatgcaaagaaaggtgccgatgtgcgggaagaagtcttccggcagatggcagagcataacattccggtgctggagatgaagaccgtgacgaaatctctcgaagatgtattccttgagattacccaggaaggaggtgcacagtaatgtttgccgtattgaaaagagaattccggtcatatttccagaatgtgatcggctggctgtttgtggccgcccttatggcactgttcggactgtatttttatgtgtataatctccggcagggatatccgtatctgtattatacgttaagtgccattacgattatttttatgattgcggtaccgatccttaccatgcgcagttttgcagaggaccggaaaaataaaacggatcagctgatgctgacagcaccggtaccggtggcaaaggttgtgctcggaaaatatctggcaatgcttgcggtgtttaccgtggatattgcagttttctgtgtgacaccgctcattttacgggcgtttggaacaattcccatgggcgagagctatattgccatactggcgttctggttatatggagcagcttccattgcggtaggtatgtttatttccgcattgacggaaagccaggtgattgcggcagttctgacgtttgtggtattgtttatcagttatatgatgcagagtctgacaggacttatttcatcggatggaaactggctgacaaagattttaaacggtctggatctgtatgcaccgtttgaaaaattccaggggggctgtctggacattacggcaatcctctattatgtaacggttattgtgttatttaatttctttaccgtgcaggccattcagaaacggcgttggagcatcagcaaaaagacattttcgctcagcgttttttcaagcagttttatagtcgtagttttagctcttgccgtggttgccaacctggcagtcgatgcgctgccgacgagaattacctcggtggactgttcgtattctaaattgtattccattacaaaggatacgaaaaagaccatgaaaaaactgaaaagtaatgtgaccatctatgttctggcagcggaaaaaagcaaggacgcacagattgattccatgctggagcgttacaaagatctgtctgggcatatcagggtaaaatacgtcaatccgaagagtaaaccttatttttataaggactatacggacaatgcaccgaccagcaacagtctgatcgttgtcagtgacaagcgttcgaaagtgatagattattatgatatctatgattatcagtcaaacatggattattccacatattcctacaacaacgaactgaagggattcgatgcggaaggacagattacaagtgccatccagtatgtaacgatggatgcaaaccagctccctgtcgtataccagatcaccggacatgatgaggctacaatcggaagtgcattttcggatgtcatcagcaaatccaatatgacattgtcttccgtggaactgttaaatgaagaaagtgttccgaaggatgcggcagcgattattatcaatgcaccgcagaaagattttaataaaaatgatgcacagaaagtaattgattatctgcaaaaaggcggaaaagcgattatcgtgggaatgcattccgagaccgagatgccgaattttgcatcgattctggatacttacggagtaagccttaccacagggccgatcgcggataatgatgcacagcattattacaatatgggaggtccgctgtatctgctgccaaatgtaaacagcagttcgtataccggaagtctttccggcggatatgtatatcttccgatttctctgggaatcaattatccgcagaacagcacgacggatgatacggagagtacagaggagagtaagacaacgtatacttctttactggatacttccgatgatgcggttgcaaagaacaatccaaacagtatgcaggattatggatacgaagatggagacgacaagggaccgtttagtgtcggactggcggtagaagataaagtagatgatgatcacacgacgcagcttgtggtattcgcaagcccgtatgtattcagcgatgatgcaagtcagatgacgacaaacaatgcatcactgttttccgatgtgatcggaaatatgatcacggatacccagtcggccggcagcgtaattccggaaaaagagtacacgctcagtaatctgacagtaaatgcattacatgcggcacttctgggactgctggttaccattattcttccaatcctgttactggccggaggaattgtaatctttatggtaaggagaaagaaataaagaatgaaaaagcagaaaatacagatgcttgtggtggtcattcttctggtgatctgcgttgttgcttatatttttatcagcaaaaacgcagggaaactggattccacagagaatgacggaccaaatgcatccatgggaaatgtgacagaaagtgttctggaaacagagacagaatctgttcagactacagaaacaacagaaaaataattatttcttgtgcgtaagtttgtataggaacgtataagcccagatcagtaccgggatcacgaaggtggcaaagatagaagctttgaacattttcatggttccggtattgtctgtgatggcgcataccagtgtacttaggtacagaacaatcagtaaaatgatgccaatgatggcaagaatctgttttccttttttcatatgaacaacctccttggctaaatatgctatttgcaggaaacctgtaaaccgtaactttatgatacgggaaatggcaggtttcgtcaagaaagggcttggaaaatggcagacattttgttataataaacgtacatgcatcaaggcatgtaaattcgtaagtgataaaggtggtataaaaatggctatattgcaggattggcagaaaattgcctacaatgagaacgcaagtcagggggaacttcagaaattctggcagagatatttcctgttagagaagggtgtgtatgagaaattattgacaaacccggatgaaaaagtagaaggaacggtaaaagaacttgctgataagtatggacttaccattctggagatggctggtttcttagacggaatcaatgacagtctggtaaaagacaatccaatcgaaacaatggatgaaaataccagggtaaatctcgttttcgataaggaaaagctgtacaagaacatggtagatgccaaggctgactggctttacaatcttccgatgtgggatgatatttttgataaagagacaaagcacagactgtatatggaacagaaaaaatccggtacggttatcgttggcaaaaaggtgggacgtaatgatccgtgtccatgcggcagtggaaagaaatataaattctgctgtggaaagaataaataaatttcaaattttgaaatacaaattcccggtatcagaaaaactgataccgggcttttttaaaaagaagaaccggaacagaataagaccatgtggtttggtacatactgatgtggcagcgatgatttaacacaaggaggtatgtaagatgacaaaactggattgtaatgtggtaaactgttcttataatgcagacaactgctgcagacgaacggatattcaggtggaaggaacacaggcaaaaacttcttccgaaacctgttgtggaagttttgcaccgaaaggaagtggatgtcagtcctgtcatacaacagatgtcaaaaaagatacaaccgtcagctgtgaagcgtgtgagtgcaaattcaacgaggatcatgcctgtcatgcgggacacattggtatttccggcggacatgcagacagcagcagggagacagagtgcggcagttttgtatgcagctgctgacaggggcatatgggcggcagactgccgccctgccagtgaaaggagaaaaggaatggaacaactaacggattacagtattaattttccgcatttacatatttatttgcaccatgtcggaaaaaatatcatgatcggaaatttttcggtggcatattatggaattgtgattgcaatcggaatgttagcaggacttggaatcgcctgctggatggcaaaacggaccggccagaaaacggatacttattttgacctggcactcgttgccattatctgttctgtcattggggcgcgggtttattatgtgatattccgttgggatctatacaaggacgatctgctgagtgtgttcaatctgcggcagggaggtctggcgatttacggaggcgtgattgcggcaatcattaccgtgtttgtgttttcacgggtacggaaactgtccatgggtctgctttgcgataccgcgggacttggtctggtcttaggacaggttatcggccggtggggaaatttttttaacagggaggcatttggcggttatacggacgggttgtttgccatgcagctgccgctttctgctgtccgatcctcagatgtgacggacagcctgctgcagcacgtggtggaagtaaatggtatctcttatatccaggtacatcccacgtttctctatgaatccttgtggaatctggttcttttgattcttctgatcctgtttaccagacacaagcggtttgatggggaagtctttttgctgtatctggcagggtatgggattggcaggttctggatagaatccctgcggacggaccagctgctgctgccggtcatcggatatccggtgtctatggcacttgcagcacttcttgtggtcgtatcggtttcctggatcatcatctggcatgtccgccagcacaaaaaaacagcataatgtacatttggatgggaaaatcctccacacgtttccacgtgtggaggatttttttttggaaaaaacggtagctgtcggctcattttcaagaaagaccgggaataacccttgatttcagggggcttttagggtattatggatacatagtggtggaaagtggaataaaaaatccactttgtggtgtaaagtggtgaacaaacagaagttcagaaaatgaggaaggggaggtgagtctgccatgtttatgggcgaatacaatcattcggttgatgcaaaaggcagactgatcgtaccttctaaattccgggaacagcttggcaatgaatttgttgtgacaaagggactggatggatgcctgtttgtttattcccaggaagaatggaaacggattgaggagagtcttcgtgaaaaaccactgacttcaaaagatgcaagaaagtttatgcgattcttttttgcaggagctgcaaactgcgaagtggacaagcagggaagaattttacttccggcgaatctgagggaatacgcaggaattgataaagaagttgtttccgtcggcgtattcagccgtgtggagatctggagcaaagaacggtatctggaaaacaacgattttgatgacatggatgagatcgcagagcatatggcagagttgggaattggaatctaaatatggagtttaaacattattccgttcttttgaacgagacaattgaacaattacatattcgcccggatggcatttatgtggatggaacgcttgggggaggcggacattcactggaaatatgcagacatctgacaaccggaagactcatcggaatcgaccaggatgcggatgccattgccgctgccacagagagactgaaagattatgcagacagggttaccatcgtaagaagcaattatgcacagatggcggacgtgttgaagaatctcggaatcgaaaaagtggatggaatcattctcgatctgggagtttcttctttccagctggatacaccggaacgcggttttacctaccggagtgaggatgcaccgctggatatgcggatggacaagcgtcagcgcctgaccgcaagggacattgtgaacgattacagtgaagcggaactgttccgcataattcgtgattatggagaggatcggttcgcaaagaatattgcaaagcatattgtacaggcgcggaaagaaaaaccgattgaaacgaccggggaactcaacgcaatcatccgtggagccatcccgatgaaagtacaggtgaccggaggacatccttccaagcggacgtatcaggcaatccgcattgagctgaatcatgaacttgatgtacttcgcgatacgttagataccatgattgatttgttgaatgatgggggaagaatctgcattatcacatttcattcactggaagaccgtattgtaaaatccaacttcaaaaagaacgaaaatccgtgtacatgcccgagcaatttcccggtctgtgtatgtggaaagaaatccaaaggacgtgtggtgacaagaaagcccgttctgccttcggagaaggaactcgaagagaacagcagatcaaagagtgcaaaattacgcgtgtttgagcgtgtggaagatggaatggaaagcagggaagcgttatgagcagtaaaaactattatgtaaacgggaataccgtgagagaactggatacaccggttcgacacaatcagagaacacgcaaagaaatcgaagaggcaaggcgccgcaaaaaccgtagaaatgcagcgagaaggaatcgccagagagcgatggagatgagccgcgggtatgtggtatttcttacggcatgtgtagtgatcactgcactgactgccgttttgtttgtacaaatgcagtcgcagatgacgacacgaatgaaaaatgtggcaaatctggagagtcagctagcagatcttcgcgcggacaatgatgcacgttataaaaatcttacaacttcaacagaccttgaacatatcaaaaaagtggcaatgaaaaagcttggcatgaaatatccaacggaaaaacaggtggtatattataccgtggaaaacagcaatttcatggatcagtatgaggatattccatccaaataacaggagtcagatgtgagaagaaagagaagaagaccggcacagaaatttaaccggaagatgcggacaaaactgatggttttgttttcccttattctggctgttttgtgtggactgatcggcagattgacttatattgaacacacgaaaggggaaacctatcagaaaaaagtactttccatgcagtcctatgacagtaaaacgattccgtaccagaggggagaaatcatcgaccgttccggtacggttcttgctaccagtgtggcagtctataatgtgattttagactgtaccgttgtcaatgacaaagaagagtatgttgatccgaccgtggaagcactggtgaaatgtttcccggaattggatgaaacggagatccgcagaattataaaagaaaaaaaggataaacgctatattgtacttgccaagaaagtaccatatgacgaagtacagccttttgtggaactgcaggatgccgtagacaaaaagggaaacaaagtgaacccggatatcaagggtgtctggtttgaaaaagaatatcagagaaattatccgtttggatctttagcctcttccgtgattggttttacttcttccgggaatgtcggcacaaccggactggaaaattattacaacagtacgttaaacggaatcaatgggcgggagtacggttatctggactcggacagcgattttgaaaagaccgtcattgatgcacaggacggggatacgctggtgacatccatcgacgcaaatatccagtccatcgttgaagaaaaaatcaaagactggaatgaaaaataccgggacaactattataaaggaaccggaagtatcaatacggcagcgattgtcatgaatccaaacaacggagaaatccttgccatggcagattatccgaatgtggatctgaataacccgagggatctgggaaaatggtacaccaaaaaacagatcaagcgcatgtctgaggatgacaaaatggatgcgctcaatgagatatggcagaatttttgtgtatcctcaacgtatgagccgggatctgtacagaaaccttttacggttgcgtgtggacttgaaaccggaacaatcaaagataaaatgacatttgactgtgatgggtacgaggattttaatggacagaaggtgcgctgcgtggcgcgctacggacatggaatagaaaccgtccggaagacacttatggattcctgtaatgatgccatcatgcagatgtcatacaaaattggaaagaatcattttacagagtaccagtccatctatggatttggacagaaaacgggaattgatctgccgggagaggcaaataccgcatctttgatgtatcaggtggaagatatgaaaccgatcgatctggcaaccaatgcattcggacagaactataactgtacgatggtccagatggtgagtggatttgcgtcactgatcaatggtggaacttattatcagccgcatctggtaaccaaaatcacggattcgacaggaaatacgatttccacggtggaaccgaaagctgtgaaacagaccatttcccagagtaccagcgataaaatccgggattatctgcagagtgtcgtaaaggaaggtacgggaaatacggcaaaagtggatggatattctatgggcggtaaaacaggaaccgcacagaagtttccgcgtggaaacggaaaatatcttgtttcatttatgggatttgccccatacgacaatccgcaggtactgatctatgtggttgtgaatgaaccaaatgtggcagaccagccgcacagcgtgtttgcgcagaacattgcgcgtgagatcttagaagaagttcttccgtatatgaatatttatccggatgaaaagaagaccggtgtaaacaagggctatgatgttaccgggtcaaaagacagctcacagtataccggaaagcataacggaaccaagtccagaaatgaaaagaaaaagaagaactaaagacagagagttcttagaaaggctctgcagtgcatatgctttaagaaaaggatcgtggtgcttttcatggagtggaataaaacctatcaccgcagaaaaatatgtatcatattcttttctgttgttctgatgtcgatggttttgtgcgggcgtctggtctatcttatgctttttgagggaaaatattatgagacgcaggcaaaagatctgcagcagagagaaagaaaaataaaagccgccagaggcaaaattctggatcgaaatggtgtagtactggcagataacaaatcagtctgcaccatttctgtcatacataaccagataaaggaaccggaagcggtcattgccatgctcgtaaaggagcttggaattccggaagaaaagatccgtaagcgggtagaaaaatattcgtctctcgagaagatcaaaagtaatgtcgataaggaaaccggaaaccggattctggcctatggctatgcaggggtgaaagtggatgaggattataaacggaattatccatacgatacgcttgcctcaaaagtgctggggtttaccggcggggataaccagggaattatcggactggaaagtgtgtacgacaaatatctggagggaaccgatggtctgattctgacgacaacggatgcccgtggtgtggaagttgacaatatcggagaggaacgcaaagaacctgttgccggaaataatctgcgcacatcattggatgcaaatattcagatgtttgccatgcaggcggcaaataaagcatatattcagaaagaagcggattctgtcagtattattgtgatgaatccttccgacggagccgtcatggcaatggtggattatccggaatttcatctgaatgagccgtttcagctgattgagaagtataaggagtatgagggtaccaaaaaggagcaggaatactgtaaccggatgtggcgaaaccagtgtatcaatgatacctatgagcccggatcaacgtttaaggtgattaccgcggcagcagcactggaagaaggcgtggtttctttggaagaccggtttcactgtccgggatatatcgtggtggaggaccgcagaatccgctgtcacaaaacgaccgggcatggagcggaaagctttgtggaaggaatcgaaaattcctgcaatcccgtgtttatcaatgtgggacttcggatcggtgccgatcacttttatgactattttgagcagttcggtctgttacataaaacggggattgacctgccgggagaggcttcgaccatcatgcacaagcgggaaaagatcgggcttgtggaactggcaaccatctcattcggacagtcatttcagatcacaccgatccagctggcaaccaccgtttcttctattattaatggaggaaaccgcgtgacaccgcacgtcggaatgcaggtggagaatggagacaaaaaagtaataaaaacgtttgattttccggtgcaggagggaatctgcagggaggaaacgtcggaaaaaatgcggtttttgctggaaaaagtggtatccgagggaggcggaaacaaagcatatattgaggggtatgagattggcggaaaaacagccacttcacagaccctgccccgttccgcacataagtacatctcctcgtttctggggtttgcaccggcggatgatccgaaagttctggtacttgtgatcataaggaacccttccggcatttattatggcggtaccattgcggctcctgtggcaaaggaaattttcgaaaacatactgccttaccttgaattggagcagtaaataccttataatcgtaattatacgcaaagatggaggttgatcgtaatgaaacttgaaggaaaaaaggttctggttgtgggagccggaaagagcggcattgctgcgtcagaactgttattggataaaaaaattgaaactgttctctatgatggaaacaaagatctggatgtagaaaagttatatgaaaaggcactgaaactgaaaggaatgccggtgcttttgggggagctgacggatgagcagctgcgcgcatttgatgtagcagtcttaagtccgggcgtcccgacggatctgccggtcgtagagcggatgcgtgcacagaacgtctgcatctggggcgagattgaacttgcatattccttcgcaaaaggcagactgattgcaatcaccggaacaaacggaaagaccactacgacagcattgaccggagaaatcatgaaaaattatttcaaggatgtgcgcgtggttggaaatatcggaattccgtatacttccgaggctgccacaatgacggatgaaaccgtaaccgtcgcagagatcagcagtttccagctggaaaccattcatgagttccatccggaaatatccgcaatcttaaatattacgccggatcatctgaaccgtcatcatacgatggagtgttatatccggaccaaagaggcgattaccaccaaccagacaaacgatgaggtgtgtgtactcaattatgaggatgaggtgcttcgggcattcggagagagcgcaccggtgcatgtggtctggttcagcagtgcaagaaaacttgctgaaggattttatctcgacggagaggaaatcttttatgcgcatgacggaaacaccgagaaggtgatcaatgtcaatgatctgaatctgctgggacgacataactatgaaaatgtcatggccgcaactgccatgagtgtgaatttcggagtgccgatggagaaaatcgtggaggtgctgaagcgtttccaggcggtagaacaccggatcgagtatgtgaccgaaaaaagaggggtccgtttttacaacgattccaagggaaccaacccggatgccgctattcagggaatccgtgcgatgaaccgtccaacgcttctgatcggaggcggttatgataagcagtccacatatgatgagtggattgatgcatttgacggaaaagtaaaaaaactggtgctgatcggacagacagcagaaaagattgaagtgtgtgcgcataagcatggttttatggataccgtgcgctgtgagacctttgaggaagcgatccgttactgctatgaccatgcagtatccggggatgcggttctgctttcaccggcatgtgccagctggggcatgttcccgaactatgaggagcgtggacggatattcaaagaaatcgttcgtggattagaggagtagtgagtcgtgccgaaacggagacgtggggaaaagaaaacaacatattttgactataatctgttgtttatcattattttcctattatgttttggactggtgatgctttacagttccagttcgtatacatcagcaaataaatatggggacagtgcacattatctgaaactgcaggcgcgaaatattgcaatcggtcttgtttttatgttctattttgcaaagaaggattatcatgtgtggagaaaattcggaaggctggcatactggggagccctggggttttgttttgtcgttctggcaaaggtaccggggctgacgcgaagctcccacggacagtcccgctggattcaggtcggaccgatcggctttcagccatcggagcttgcaaagattgccatcattatttatctggcgatgctgatcgagcgtatccccaagcagctggataaggtttcaagcatggcaaaagtaggaatccgtctggtgccgcttgttgtgtttgtcgcggtaaacaacctgagtacggcgattatcattcttgggattgctgtctgtatgctgtttgtggcaagcccgaagtacaaagagttttttgtggttgccgtgctgggggtgctgtttattttcgcatttatcaatatcgcgtcttaccggagtgaccgtgtggaggcatggaaacatccggagacagcgggagataagggatatcagaccatgcaggcactctatgcgatcgggtccggcaagctgtttggaaaaggactcggacagagcttgcagaagcttggcaatgtgccggaggcacagaatgatatgattttttccattatctgtgaggaactcggccttttcggtgccgtctgtgtcattcttctgtttgtcctgatgctctggcggatgatggtcattgccaataatgcaaaggatctgtacggggcacttctggtgacgggcattatgtcacatattgcgattcaggtagttttaaatattgcggttgttaccaatacgattccgaataccggtgtcattctgccgtttatcagttacggaggtacctcgcttgtattccttatggcagagatggggcttgcgctgagcgtgtcgaagggcatccgtctggatacgatcgagtaggtttgtcatgattaaagaagaacgaagaaaaaagaaaaaaagaaaaaacattctgcaggtgatactgggaatcctgattgtgcttgcgctggcagttctgatcatttttaccgtttttaaagtaaaaaatgtggaggtggagggaaacaaactctatgatgccaaagtgattgaaaaagcagtattaaacgatgagtattcctggaattccctgtatgtattcctgaaatataaatttgtcaataccagtgaagttccgtttgtggacacgatggagatcagcctgaaagatccgcagactctgcatatcaaagtgtatgagaaaggaatcatgggatatctgtatctctcctcgatcaataagaatgtctatttcgacaaagacgggattgtgacagaattgtctgaccgtgtgattgaggatacaccgcagatccttgggattgactgtaaaaaagtagtgcagtatgaaaagctgccgatcggctcgaagcggctaaagcagcttctgacgctgacgcagtctttaaaacgcaatgacctgatcccggattccattacctatggtgtggaaaatgagccggttctgacatacgggacggttaaagtttccatgggttccctggaatttctgacccagaaagtggagcggctggcaaaaatcaagccgcagctgcagggaatggaaggaacactacatttagaaaactggacagaagaaacgacaaatattgtgtttgacaaaacggaaagttcgaaaaaagataataaaaaatcataattttcggttgattatttgtatgaaaaattatattatagtctatatgagtacgtatgaaacatttttatgtttcacggtgccgcagggctataggaaagaggaggaagaaccatgctggagattcggacaacagagacagatacgagtgccaaaattatcgtgattggtgtaggtggtgctggtaataacgctgtgaaccgcatgattgatgagaatataggtggagtcgaatttatcggagtaaatacagataagcaggcgttgcagctttgcaaggctcctacgttgatacagatcggagaaaagcttacaaaaggacttggtgcaggagcacagccggagatcggcgagaaagcagcagaggaaagtgcagaagaattatccgctgcagtcaagggtgcagatatggtattcgttacctgtggtatgggtggcggtaccggtaccggtgcagcaccggtcgttgcaaagattgccaaggagcagggaatcctgaccgttggagttgtgacaaagccatttaagtttgaggcaaagaaacgtatgatcaatgccgtatccggtattgagaaactcaaagagagtgtggatactttgattgtgattccaaacgataaacttttagagatcgttgacagacgtacttccatgccggatgcattaaagaaagcagacgaagtattacagcaggcagtacagggaatcacagatctgatcaatctgccggcacttatcaatctggattttgccgatgtgcagaccgttatgaaggacaagggtatggcacatatcggtatcggtaatgccaagggcgatgagaaagcaatcgaggcagtgaaacttgccgttgcatctccgcttcttgagacaaccatcaatggtgcaagccatgtaatcatcaatatttccggtgatatttccctgatggatgcaaatgatgcagcaagctatgtacaggatctggcaggagaagatgcaaatatcatcttcggtgcaaagtatgatgagaccatgacagatgaagctacgatcactgtaattgcaaccggactggagaatccatccatgaagatgaagccacagcagcaggcgggtggaatcggtggccgtatggtatatccgaatacaaacaatgtccgtccgacaggttccgttggaattgtcagccgtgcagcagctgctggaaacaatagttttcctggggtaaataacagcaattacgccaatgcaggtaccggtgtgggaagcagaccggtcaatcagccgcaggcacaggcaccgactccttccgcttcgaactattccgggattcagcgtccgaagccggtagagagtaatgtaaagccggtagaaattaatattccggatttcctgaagaaccctagaagataaaaccgcacaatatgtcgataatttccaaataacaacctcttgtttttgctaaattatgaggaatatttttcttataataggagcagagacaggaggtgattttttatatatgtattctatattgatatctttctgaaacaaaactttctgatgaattttcttgtattatcccttacctgtgtattttgcaaaagtgcagtctgtcaccggaatctgcgcatgttagctgccgcggtttccggcacgggacttgaagcgtttggactgatggtgctgccttatgcaatttccgttctgtgtactgccatcggcatcgtgccgcttatggtttttcttgcgtttggcagggaaaataaaaaacagaggatggtgaggattttaagcagctggttgtccattgtattgttaaacggagtggcaactgcagtttacaatctgacgggactggaaaatctgtatctgtataccgcactggcaacggccggaatcacttacgtacttgtcaaaaatcttgtggtgtcggtgcagaggcaaaagcgacagatgtctgtggtcctgtataacaaaacggtgtcggttccatgtatcggactgctggattccggcaatcttttaaccatgccattaagtgggaatccggtacatattgcagatgcagccctgctgcagaagcttgtcgatgaaaaaacggtacaaaaggagattccataccgtgcactcggaaatccacatggaaaattgcaggtgtactgcatggatgggatgaaagtggagacggagccggcaaaattctgtgactggaaacaggtatgggttggctgcgcggaaaatggggtgctgtgcaataaaccgtatcagctgattctgcatgcatcggtggcagaccactgtggctgcacaaaaagatccatcccaaatgacaaaaaaactgagaaaggagaaacgtaatgttttcactgtttgaactggtgtggaagagaatccgcctgttttttacggatgatgaggttttttacataggaggggcagatgtactgccgccacctttggagagggagcaggagaaccgctgtcttatcgctttaagcgggctgcatggggacagtgaacccatgacgcgcgaagacgcaagaaagcagctgatcgaacacaatctgcgtctggtggtatatctggcgcggaaatttgaaaataccggaatctgtgtggaggatctgatctccatcggaacgattgggctgatcaagggaatcaatacatttaatccggaaaagaagatcaaactggcgacttatgcgtcccggtgtatcgaaaatgagattcttatgtatctgcgcagaaataataaagtgaagctggaggtatcgattgatgagccgttgaatgtggactgggatggaaacgaacttcttctttcggatattcttggaaccgatgaagatatcatttaccgggatatggagaatgaggcggagatcatgcttctccgcactgcggttaatacgctgactccgcgggaaaaagaaattatctgtctgcgctatggaatcggaagaaaagacggcagggaaatgacccagaaagaagtggcagacctgcttggaatttcgcaatcctatatttcgagactggagaagaaaattatggtgcggctgaaaaaatcaattcaaaataatgtgtaagtgtgctatactaattacataaaatttgctctgaaatagtaaaatttatatgcaaaataacaaggacagcaggatgaaagggcgtggtttttatgaagattgaatttttaggggcagaccgtgaggtaacgggaagctgccattatgtggcatttggggagactcattttctggtggactgtggtatggaacagggggcggatctgtatgtgaatcaggagataccggttaacccggcaacgattgattatgtgtttgtgacgcatgcccatattgatcattccggacttctcccacttttgtataatcacgggttccggggaaagatttttgcaacaacggcaacctgtgaactgtgtaatatcatgctgaaggattcggcacatattcaggaatttgaggcagaatggaaaaaccgcaaggcgcggcgtgcaggaaggccggaagtgacaccgatgtataacatggaggatgcgcagggggttttagagcatttcgttccgtgtacataccatgaaacggtgcagatctgcgagggactgaccataaggtttgtcgatgcggggcatctgcttggctcctcctccattgaaatatgggtgactgaggatggcgagacaagaaaacttgtcttttccggggatattggaaactgcaaccgtccattgatccgtgatccggaatatcttgaggaagcggactatgtgatcatggaatccacttatggaaaccgcaatcacaatacaccgccggattatgcggcagaactggcaaaggtgatgaattccacgtttaccaaaggcggaaatctggtcattccggcattttctgtcggcaggacgcaggaaatgctttactatatgcgccggattaaaaccgaggggctgctgccggagtatccgggatttgaagtatatatcgacagtccgcttgccgtggaggcaacaaatattttccataagagtgtggaagagtgctttgatgaggaagcaagacagctggtacagtcgggcatcaacccgatccagtttccgggactgaaagtggcagtttccagtgaagaatccaagatgatcaatttcaaccagaaatccaaagtgattatctcggcttccggcatgtgcgaagccggccgtatccggcatcatttgaaacacaatctgtggcggacggattccacgattctgtttgtcggctatcaggtgccgggaacgctgggctattctctgttaaacggagtaaaaaaggtaaagcttttcggagaggaaattgaggtcagagcaagcattgtaaaccttccgggtatcagcgggcatgcggacagggatcatctgactgcatggattgcaaactttaagaagccgccgaagaaagtgtttattgtacatggcgaggaaaccaccgcggtagagtttgcggaacatgtcaaaaacgaggtgggatttgatgctttagctccatatagcggggatgcgtatgatctgcttaccggagaacagatcgcacagggaagcagacagcttgtggagaaaaagacacagggtgtttaccgtgcaaaatccggcgcgtttgaccgcctgatgatagcaggagaacgtctcattgccgttattaaaaaatgtcagggcatggcgaataaagatcttggaaagtttgcggatcagatcaattcgctctgcgataagtgggaccggtaaatttgatgggaaagcgggacttacgtcccactttttccatgtccggaacaaccggatgaaaatgaataaaaaaacagcacatgggaatcctttattataaatccaattataacggaggaatcccatgtctacgtacaaagttgaaatctgcggggtaaatacggcccagctgccaatactgaaagaagaagaaaaagatgaacttttcaaaaagataaaagccggcgacaaggcatccagagaaacctatatcaaaggaaatctccggctggtattatccgtgatcaaacggtttaataatcataatgaaaatgtggacgatctgttccagattggctgtatcggactgatgaaggcaatagataattttgatacgagtgtcggggtgaaattctccacctatgccgtcccgatgattatcggtgaaatccgccggtatctgcgggataacagcagttaccgcattccgcgttcgctgcgcgatattgcatataaagccatgcaggcaaaggaacggctggcaaaaaatgcacaaaaggaaccgactctcgaagagattgcagccgaatgtgagattccggtggaggatgtggtgtatgccctggatgccatccagacacctttgagtctgtttgatccggtttatacggatggaggggacaccctgtatgtgatggatcagatttcggacaagaaaaacaaagaagagcactgggtggaggatttgtcactttccgatgccctgtcacatctgaatgaacgggatgagcatatcatccgtctgcgtttttttgagggaaagacacagattgaagtcgcggatgaaattcatatttcgcaggcgcaggtgtcgcggctggagaaaaatgcgttaaaaagtatgcaggggtatctgcgtacatgatagcggcctgttgtaaaatggttttgttattgctatcatgtggaatatacaaaacggagaggaaaagaaatatccggcagtagaaaattgcattcttgctttttgcggtgtactgtgctatactgtcaaccgttgcagattctgtaaacaggggattgcacgaaaaattaccgagtgttcgagaccttccactcgtaaaacaaaactaaaggagacaaatggatatgagagacaaaaaggtaacatttattgttcaggctgctgtgattgcagcactttatgtagtgctgacttttgtagccaacgcactgggacttgcatcccacacaattcaggtacgcttttccgaagcactgtgtatcctgcctgtttttacgccggcagcgattccgggactgtggattggctgtctgcttgcgaatctgttgacaggtgccgtgatttatgatgtcattttcggaagcattgccacgctgctggcagcggtatgtacctatctgctgcgcaatcacaagattgcatgcacatttccaccggttatttttaatatgattattgttccgttcgtgctggtctatgcgtacggtattccggcagtatatttccacggtgtgaatgtaaccatcccgtttaatgccatgacggtcggaatcggagaggtgatttcagtatgcgttcttggaagcattctgatgcgtgtacttgcaaaatacagaaatgtcatgttccgtgccaccgcacaataaaaaattatatctaatagaaggttctggaagtccctgcgagagcaggggctttttattttaagaaattctgtaaataagccagacaattttaagaaaaccttaatgtcattccaaaataacgtatgttatcataaatgacaggaaaccgtaaagaacatttatggaaggagaagattatgaaaataagaaagacaatctgcagtctgcttctggtatgcctggcatttttaggcatattttgtggcagagcaaatgtatatgcagatcagaaacaggcattgtcggcaacggtgactctgctgaaacaggaaaaagactgtgtcgtacaggtggaggcaaaaaacagcggggcggattttaccgggaaggtgcgtctggtgttttccggtaccgacaactccaacggctgcgcatttgaacagcgcctgacattgccgcagaacggaaaaaaacagtatacaatgaccattccgtatgcggatgtcagccagacacgcggaaacggaatcgtggcatttatcgatgaaaagggaaacgttgtggcaaaggaagcatttgccagtatttttggcaaagaaaagcgcggtattggtgtgggagtgctttcggatcattatgatgcgcttggatggatgagcatgagcggccagacctattatcttcacggaaaagaccagaatgtatatctgacacagatggacgcggatacattgcaggcgcagctggatgaactgtattttcttgtgattgattcctacgatgtgagttcacttgggaaagagaatatcaaggcaatcgagaaatgggtgaaaaacggtggatggctgctgattggaaccggagagcgcggcaaagatacactgggtggttttgattcctcatttatggaggtcagctgcaaaagcgtcagcaaagtgggagaagaaaatgaggtatcgaaagaaatgcagcaactgggaagttattccggatttaccgggattgatttttcacagatgccggttgcaaagctgcagcggaacaatacaaatgcaagcaaaagcgaagcttatccggggtgggtgtatgcctgtggggatggtgccatcggtgtatgtgccatttcttttggcgaaaaacagatgcagaaagtttccccggatctgtgttacggaatttatgaccaggtggcaggatattccatgagctattcccagtatgtcaatgacgaggaatggggatggagtggggaaaatgcattcggtgtcattgaccacctcaatacggcattggatttttcctggctgaaagttctgatagtggtctatgtgatcgttgttggaccggtgctttatcttctgctttgcaagatgaaaaaaagagactggtactggctgggggtaccggcgcttggcataatttttatcggtgtggtatttatcggcgggcggaatttaaagctgcatgagacacgggtttattcggtgaccgcacagcaggcggatggaaaaagtaccactggtatcgccacctattacaatgcgtatcattccggggtaaaaccgtggaaggtacggctgaatgataattacgcatatggtggtacaggtctcagtgaatcttatagtatggcatcttccggcagggtatatgaagaccgttatcactatttggtggaatatgacagggggctgtcccttggggtaaaaccgcagagcaattttgaaaatgcctatttgtttgcggcaggaactgccaaaggatgtggaagcatagacaccagtggtctggtgctcacgcagcagaaacaggggggaagcataacaaacaacacgtcctatgatttcccttatcttgtctgcgtgtcggatgatacggtcatggtattttcggatgtaaaagcaggtgagaccataacgatagacgggaaaagtaaaaaaccactgctgtcccagcagatttcttattttgatgatgtctacagcgtgttatcgcaagacaacatgaatggaaatacatattcgtataagcataaggatatggcagccgcactgtatctgggactgtgccagatccggcggaagaacgatgtgtcgggtactgttgtagtggaaggagtaaccgcagactacggaaaaaccatagagagcaggtgctcggaaatttcgtttggctgtctgtatacgattgccggtcaggaggtgtccaatgcttcaaattagtcatttgtataaaaactacggaaaatttcaggcggtcagggatctgaacctgcatgtgccaaaaggggatctgtttggctttgtgggaccaaacggagccggaaagacaacaacaatccggatggtatgcggacttatgccgccgacagaaggaaccattacgatccatggcgtggatgccctgctgcatccgaaggaaatcaaaaagcagatcggttatgtgccggatttctttggtgtgtatgacaatttaaaagtcagcgaatatatggatttttacggttccatgtaccgtatgacttccagggagatcaccgcggtatccaatgatctgctcgaactggtcaatctgtccgacaaaaaagaggtttatgtggatacgctttcccgcggaatgaagcagcggctgtgtgtggcacgggcactcatccacaatccttcccttctggtgctggatgaaccgaattccggtctggacccgcgtgcgcgtgtggagatgaaagaacttttgcagaatctgcgcagcatgggaaaaaccattgtgatcagttcccatattttgtcggagctggcagagatgtgcaacagcatcggtattatggatcacggaaaactcgtagaagcaggaaacatcgaggatgtcatggaacatgttttcggtggaaaccggatcgtggtttcggttcacggggagatggagccggcagtgcgcatgcttaaggaacacccgcagattaaggtggaatcggtgggagaaaaggaaatccatatctcgcatgccatgaaagaggaagaaatcgcgcagttgatcgcacagatgatacagaatggaattatcgtgacaggattttataaagaagagggaaatctcgaatccctgtttatgcagctgacaggagggcaggaagatgagaattaatccaatggtaaaaaaagatattaaagtacaggcgcgcagtatgcggatctgctgggaaatatttgtttatgaggcgattatggcagttgtatttttctttgccatgtttttgttttcccagcagatgacctattcgtctgcaaacatatacagcagcattgtctggctgtatccggcacttgcggtcacgcagatttttattctgggagtggtagtcccggtgcgcacggcttctgcaatttcgggtgagaaagagcggcagacctttgatattatgatgacaaccagcatgaccggattttccattattatgggaaaggtgatcaccgcgatgatccagagcatgttttatgtggtggcaggacttccgatcgtagcactggcatttgtcatcggcggactctcatggggcaatctgttctggtttctggcagtatcattactggtttcgttcgtttctgcaagtattggaattttgtgttcctccatctgtaaaaaaacgatcagtgccataattttatcgtatggtatctatgttctgctgtttatcggaagttttcttccctatctggtcacctcggttgtccgcatgtcaggtggggtaccggaaaaatcctgctgggtgcttctggtcaatccgggtatgtatctgcttgaattttttacctggagtatgaccggaacatccgtggcggaagaactgatcacaaattacgggaaaacattttctgtttcgggcgctgccgtacattatggatggatggccgtttccacgcttttatttgtggcactggcatttgtctttcttctgattgcgatgcggcggatcaatccgatggcaggatatggaagaaaacatgcagggggaaagcagcatggatgaaaaagcatttctgttgcaggaaatccgttacagcaaaagaaaacagaacgtaaaaaagttcctgcgctatgaaagcacaggaattgccgcaggtggaaccatcgccatggtgctggaaggatgtgcggtgtttgtccctttttatacggtgcatgtgtgggctgttttggcagttttatgtggtgcggcagctggaggcatttatacggtaatgaagagatgtaccatggtacaggcagcacagcagatcgaccgtttcgggtttcaggaacggatcgtgacggcatatgggcgtatcggaaaagagggcagtatcgaccggatgcagcgcagcgatgccgtgcatatgttacaggaagaccatgcatggaaaaaggcgcgtgtttgtccggaccgaaggaaacttgtggcactttttctttcccttgggctggcgcttgttctttcgtttgtgccgtcccccgcgcataaacaggtgaaacagcggcatgccatccggcaggaagcccgggaaaaggaaaaagaaatccaaaaagtgatggatgccttaaaacagactgacaccgcttccatgacaaaagaacaaaagaaagccctgcaggaactgatacagtcactggccttatcgcaaaaagaaatgcagcaggcagatacgaagcagtcactggcatctgccgggcagaaactttcctacaagtatggacaggcggcacagatttccggggcggatgccctggcatcggtacttaaaaatatccaggtgaataccaatacaggaaaccagctggcacagggggatgtacaaagcactacacaaagtggtacgcagcgtggggaatccacgcagtcttcggaaaccagttcccaggattccggggatggggaagattcgggcagtggaaaggacggaagtggaagtggcaatggaagtggaagcggaaacggcaaggggacaggaagcggaaacggaagtggaacaggaaacggaacaggcggtggacgcggaaccggatccggagggggaacacatgattatgtgagtgttccgaataaactcggaaacgacagcagtatcacaaaggacaagggggattcgaagaattccgattattacaaggcgaagaatggtctggcatggaaaggcgaacacgtggatttagattccgtggtcggcgattacacgaaagaggcctacgaaggcattgccaatggaaaatacccggccggcatggaagatgtcatccggaattattttgaaaatctaaactgatggagaggagatcttatgacagaatatgaagtatgccagcagaacaccatggcatgtgaacaggaaattgcaaagggaattatcggacaaaaagacgtcatccgccaggtcatgctggcacttctggcgggcggaaatgtactcttagaaggtatgccgggactgggaaagaccatgctggtgcgcacgatcagccaggtgtgtgatctgagtttccagagaatccagtttaccccggatctgatgccgagtgacgtgaccggtaccaacatcatcgtaaaagaagagcaaaaaagtgcattccggtttgaaaaaggaccgatttttgccaatctggtgctggcggatgagatcaaccgtgccacgccaaagacacagtcagctctcttagaggccatgcaggaacacaccgtgacgatcggaacgaccagccatcagctgccggagccgtttctggtgcttgccacacaaaatccgatcgaaaacgagggaacttatccgctgccggaagcccagctggaccgttttttgtttaaagtgctggtaaaatttccggaccggcaggaactgcgggaaatcgtggaactgacggagggaaaccatccgccaaagatcgcaaaggtcatggaccgggaaagcctgcttgcagcgcgcgcatgcgttgcacacattccgattgcggatgccgtcatggattatattctggatctggttatggcaactcatgcagacaatccgtatatccgggagggggcaagcccgcgtgcggcacaggcactgatccgcacggccagggcacgtgcgtttatggaaaaccgcctgaatgtatcatttgaggacgtcaaatgtgtcgcgcttccggtattgcggcacaggattctactcagtttcgatgcagtatcggaggggattacggaagatgcggtgattgggcagatcttaacagaaaaggaacagggactgtatgcttgatgcgggaatttatgaacagctgtcgcggcttgtgatcgcgatgaaacagaaaagcagccagaatatggcaggaaaccgcagatccgtacagaaagggacttctgcggaattttccgatttccgggagtatatgccgggagatgatctgcgcaggctggactggaatgtctatgcgcggtcggagcgcatgtatatccgggaatatttcgaagaaaaggaagcagtggtatcggttattttagataccagtgcatcaatgcactatggaaaaaagagcaaggcagaactggcacaggatctgtgcgcggtgattgcctttctgactttgcaccatatggaccggctggtgctgtatgacagcagccagatgggaactccgcttgtggtttccgggggaaagaatgcactgccaaaagtacttggatggctgcaggcacgtacattttcggggacagagacggattctttttccgccgtgcgccagatgcagaggcgtggggcgggagttaccgtgatcgtcagtgatttcctgaccgaagcagcgacagatcccacgcaggattgtctggaaaaaacgatgcagtatctggactttacgaaacaaagacccgtgttgcttcagacactgtgtgcggaagaactgcgtgtgacaatggacggtacgcgcaatctgatagatatggagtccaaagaaaaactgcgcgtgacgatgcgtgcggatgtgattgcgcgctatgaacaggaactgcaaaagctttctgtgcggctgaaaaaaagtgcatcggctgccggaggaacctatatactctgtgattccgaaaaagagagacgtgcgcttattttagaagatttaagacctttgtttgtctgagaaaaatttgaggatggattatgatatttgagagtttgtggccgctggcatttttgctggcggttccggttgttgtgattttatatctgcttgtgccaaaggggacagacacaccagtgtcttcgaatctgttgtggaagaagcttttttataatgaacagtctaaaacgttctgggaaaagtttttgcacaatctgctgatgtatctgcagatcgtgatccttttgctgcttattctggcactgatggcaccgtttgtacagcgtaagggtacaggcagtacggacgtggtgtatctgattgacaccagcggaagcatgaagcatctcaccaaagggggcaatacccgcttaggggaagccgtaagtgagatcaaagagcagattgccgcttcggatggggcaaaaatatccattgttacctgtgacggcacgggaaccaatctgcttgccgtccatacttccgagaaaaaagcactgtatcggacgctggcagacatcaagggcacggacacagccggatcgctttccgatgcactggcaaccgtacagacggtgcagaaaaaagacaaaaagaacgatctggcagatgtcatcgtctataccgacggcataggggcaaaacagacgaaaaatctcaaaagtcagcttcaggcaaccatccgcgtggtgggaagtcccgtttctaacgtggcgaatacgtttctgtcctgcaccaaagacagcagcggggacacgtatacggttgcatcaggcgtgacaaattacagcgatcatgcggcaaatatggagattacgctgtatgagggaaagaaaattcttgaagtgcgtacactttcccttgccgcagacgagacgtatacctgcctgtttaaacaggtgaactggggaaaccagccgctgcacaccgagctttccgcagtgacatttgccggcagcagccagaaggattccttacatgaggataactgtgcctatgcactcaaagaccaggtttccacgagcaaagccacactgatcggggaaggaaatacctatatcgaaaaagcgtatcttgccgtgaccggagagaatctttccaaggcaaaaacaacggatgcacttgaccgtgacgatccggggatttgtatttttgatgcggatacggcagtgcaggaatctaatcagcagaaggcgcggatgatttttgccaaagagggaaagaacgaggaaaaaaatgtcagcctgtccgccggcgataccgaactgacttccggaatccgggactttgcgctcggggtaaatcagacgtatgtgtatgatctgccggtctgggccacgggctttctgtggaacggaaagcagtgcgccgcatactacggggagcatgacggaatccgggaggtcgtactcggatttgatctgcgggaatcggattttgccctgcagccggagtttccggtatttatgaaccatgcgctgcactatcttgaggacagttcccttctttcccaaaacgtctatgatgccggagataccgtgcagtttcatgcattaaacggtgtggacgtgcagcagattgcggcacctaccgatcaggcaggactgtttaccgtaaaagcgggcgacagaaaggaatcctatattgtaaaatttgcatgcagcagtcagtcggatggacggattacggcaggcgattccggaagccgcaacacgatgcagcggcagcttgtgcgaaagcagatgcgcaatgtcatccttatccttgtgcttcttcttatgatactggagtggatctgttatgtccggcagatgcgttaccgtgggcggttttatcttgcggtgcgtctggtggggcttgcccttttggtgctggctgtctgtggaatttcggtgccgctttcccacgcgaaagatacaaccgtttttctggttgatctgtcggagagcaatgccgcaaatctcacgcagatggagcagtatatgagccggcaggtcaaagacatgccaaagaacaatcagtatgccatcgtaacgtttggagccaatgcggttgtggaacagtttctgaccagtgagaaacacagttttcagattctctcggcaccggaggcggatgcaaccaaccttgaggaagccgtttccacaggactttccatgatcccggacaatgcggcaggacggcttgtggtgcttacggatggaaagcagacaaagggaaacatcgagcatacggcatcggcactgacggcaaaaaacgtgcagctgtattcggttctctatgaagatacaaagcaggggagcgatgcctatatcgaaaacgtggaaatgccggagtatctttatccgggtgattcctattccatgacggtaactgtggaaagcaactatgagaccgatgcgaagctgcagcttttgcagggaacggagatggtcagtcagacaggcgtgcatttaaacaaaggcagcaaccgttttgttttgaaacagaaggtagtcggtaccgatgcgcagcagtataccgtgcgcgtgaaggcaccgaaggacacctgtgaaaaaaacaatgattatggtacgtatgcgacggtggattccctgccaaagattctgcttgtatccggaatgggagaggacagcacaccgtttttaggacttttggatgctgccggatgcaattaccggcaggtatccgcagtcagtgcaccggatactttaaaagagatgctgcagtacaagagcatcattctggaaaatgtgtaccggacagatctgccggagggttttctaaaaaatctgaaaacttatgtgaaagactacggatgcggtctggtggcatgcggcggcgaggacagttttgcactgggcggatatcaggatacggaactggagaaacttcttccggtcgatatgcagctgcgtggggtgaatgagaaacagaatctggcaatggtcatggtgattgatcattcgggcagtatgtcggaacagaccgaaggaggcaccaatctggatctggcgatcgcggctgccaaagcggctgtggatcagctggatacgaaagatgaagtcggtgtggtaacctttgatgatggttacacctggcaggtgccgctggaaaaagtgaaggataaagacaagatccatcaaagcatcgagacgatcagcgaaggcggtggaacgaccatcaaaccggccgtgcgtgcggcactaaatgaaatcaagaagagcaaggcgcagctaaagcatattgtgcttctgacggatggacagggggaaaccgagaattttgaagatatcatcaaggactgcaaggatgccgatgtaactctttccacggtagcggttggagagtcgtctgacagacagcttctggaacgactggcaacgcagtgtaacggccgctattattattccgatatctcaaccgatatcccgaaaatctttgcacaggaagtatttttaaatggagatacgtatttgcagaacgggcagttttcactgaaaggaaacagcagcaatgccatcacgaaaaatctctttgccgatggctggccgcagatcaaagggtacgtgagtgcctctccgaaaaccggagccaatgtgctgctggcatctgccgaaaaggatgacccgattttgtctgtcatgcagtatggactggggcatacggttgcgtggaataccgatgtgacaaaccgctggaccgccgggctggcacagcagaatgattacgtgcagctgtggaagcggatcatcgattacagtgcgggaaatacagcactcggcgaagaccgtgtggatgtaactactgtaaacggaacaacaaaagttacctattatgccaaagactacgcagagcagacacaggtggaggctgtgtacacggatccggatggaaaaacgcatcaggcgaaactgaccgcaagtgcgccgggaacttatgaggcacagctggatacgacagtctccggtgtctacaatctgagcgtgcagcggaaaaacggcaaaaaaatcgaaaatgccctgaccaccgcagccgtggtacagtattcgcaggagtacaaatttgcgctgacaaacgacagcttttgtgcgttcatcaaacagtatggaaagatgctttctccaaagaagaatgtatggaagaagttaaaagattccgggcgggcacgggtttgtctgaccaatccgcttttaatccttttgcttttcgtatttctggcggatatcgccatgcggcggtttgcctatgttccgccaatgccacactggacgaagccggcaaaaaaagctataatgacaaaagaaaaaacagcagaagacgggcagccggagccggaagctgaaaaaccaaaggaaaagacaaagaaaacaaaaccggaggaaacggcttcccaggcactcgatacttctgcgctgttaaagaaaaaagaaaagcggaaccattccgtttaaaagaaaacaggagtcattatgcaatcagacagcaatttacgagaaacgttacggagtatcgatcataaaagttatccggcatacaaatccctgcggggaagttaccggtttgcagactatgtgttatccatcgatcatgtgcagggagatccttttgcggcaccttcccatgtgcgcgtgaccgtggatgcaaaggcagcggcatttccggaatatgccatgaaaaatacacggacgcgcacggcactggcagatgaactgctgcgcatgtttgccgcacagatcaaccactttacatttaaggcgaagggatcgggcaagagcggcctgatctcggtaacccactgcggacaggagattctgacccggacagcctgtgaagtgaacgaaaaagaaatcaccgcgcgttttgcggtaggatttccggcaaacggacggacgatcaatgccagggaactggagaaaattctgtttacctatctgccagaatgtgtaaagtactcattttattataaaaatctcgatgcccgcagaatccgggatgccgtggaactggcagaagaccagcaggcagtccgtgaccagctgaaagaacaggggctggttgcttttgttgccgatgatgcggtactgccgcgggagagtgggatttcctcccgaccgatgaaacagtccgtagcctttacctctccggaatcccttagggtgacgatgcagcttccgcacaggggtgcggtcaccggtatgggaatcccgaaaggaatcacactgatcgtcggtggcggctatcatggaaaatccacacttttgactgcactcgagctgggcgtttataaccatatcgcaggggacggcagagagtttgtgatcacggatgagaccgccttaaaacttcgttcggaggacggacggtttatcaaagatgtcgatatttccatgtttatcaatgacctgccaaacggaaaagatacccatcatttttcaacggaagatgccagcggaagcacatcgcaggcagccgggatcgtggaaggcatggaggcgggaagccgtctgtttctgctggatgaggatacgtctgcgacgaactttatggtaagggatgcatttatgcagaaagtagtcagcccggacaaagagccgatcacgccgtttctttcccgtgcgcgcgatttgtatgagcaggcaggaatttctaccatcctggtagcgggcagttccggtgcctttttccatattgcggataccgtgatccagatggaccgctacaagccggttgacatcacaaaaaaggcgaaggcattgtgcaaagaatttccgatttcacaagaaaagacacatccgttcgccctgccacacagtcaccggatcatggaaaaagataaaaacggtgccacaaaacgcagggattaccggagcggagccgtgcgcaaaaatgagccggagcggttaaaattaaaaaccatgggaacggatggatttgccatcggaaagcagaccgtggatctgcggtatttagaacagctgatcgacagcgaacagactgcgtgccttggcatgctcttaaaatatgcggtcgaacacctggtggacggcaaacggacaattgccgaagtcgttgtacagttacagaaagaactcgaaacgtccggcatgcgttttctggcagaaaacggtatcgtttccggcggttatgccatgccgcgggtgcaggagatgtattcctgttttaaccgttatcgtgtatagaaaaagggaagcacaggagagactatgaaaagaatattagttgtcgttgacatgcaaaacgattttacgaccggaccgctgggcaatgcagagtgtgcagcagtcattccgaaggtcgcggaagtgataaaaacaggcgtgtatgacagaatcattttcacccaagacacgcaccagagtaattatctggatacgcaggaaggaaagcggctgcccgtcgtgcactgcatcgaaggaaccgaaggctgggagattgcgcctgtgatccgtaaggcagcatccttttattccaaagaacagatcgagacgatctgtaagccggcatttggcagtgtgcagcttggcgagtgcttaaagcagtactgtggtgatgcagaggcacagattgatttctgtggcgtgtgcacgggtatctgcgtcatcagcaatgtcatgattgccaaagcctttgttccggaagcgcgcgtgtgcgtgattgaaaaagcatgcgcctgcgtgacatcggagtcgcaccgcacggcgatcgaagcgatgaaaacctgtcaggtggatatacagtaattgtatcttatttaagtaagaagaaaagagaaggattatgaagttaaatcagatcatcaccagtctgctggaaacagacatgtacaaatttagtatgggagaggccatctatcaccagttctccgactataaaaccacatggacattcaagtgccgcaataccgatgtgcactttacggcagagatggtgcaggagatcaaagagcagattaaggcgtactgcagtctacgttttacagaggaagagctggaatatctgaaccacattacatggatcaagggaagctatattgattttctgcgcctgtggcagccgcgctatgaggattttaagatttcggatgaggcggaatgcggactttccatcgagacattcggtacctggctgaatacgtccttgtatgagatcccgacactggcgattgtcaacgaagtgtatttccgtatggcgtacgattatgacaggctttatgccagtttccgggaacgtctggaacggaagatcaaagatgccagcggcagatacgagatcggttcgttcagtgaattcggactgcgccgccgtctttccgcagaggcacaggagcttgctgtccgcaagctgaaagaagcagaatttcacgggtcagaatttgtcggaacgtccaacgtctatctggcaaaaaaatacaatctgacaccggtcggaaccatggcacatgagtggatcatgtgtgtcggacagggaaatcacaaacataacccggcatactccaactggtatgcgcttgatgcctgggtacgcgagtatggcgtgttaaacggtattgcactgaccgatgcgattacgaccgactgtttcctgcgggatttccagctgacctatgcaacgttattctccggcgtgcgtcatgacagcggagatccggtggagtggggcgaaaaaatgatcgcacactaccggaaactggggatcaatccggcaaataaaactttattgttcagtgattctcttgattttgcacgggcacacgagctgtacgaacatttccggaaccgcacaaaggtggcctttggaatcggcacctatatctcgaatgatacggaggtaccggcactgaatatcgtcatgaaaaccacgctgtgcaacggtatggatgtcgcaaagatttctgatactccgggcaagggaatgtgcaagaacccggattatgtgcattatctgaaacgatgcatcgactggcgtatgaatcatgacagataaaaattctgatttacagacaaaggaagaaggaacagaccttatgaattatacagagtgtatcgaacaggcgagaggccgtatcggatcttactgtaaggcgtgctgggaatgtaacggcagagcctgtaaaaaccagatgccggggccgggagccaaaggcatcggagataccgccatccgcaactatgacaaatggaaagaaatccgcgtccagatggacacgctggtcgaaaaccgtccatgtgatacgacactggaactgtttggcagaacgtttcagtatccgttttttgcaggtccggtaggcgccgtgcagctgcactacggagactgcctgaatgatatttcctacaacgatattctcgtttccgcctgtgcagcatccggcatcgctgcttttaccggagacggaaccgacagcaatgtcatggtcgcagcaacaaaagcgataaaaaatgccggcggactgggaattccgaccgtaaagccgtggaatatcgaagtgatccgggagaaaatggcgatggtaaaggattccggtgcctttgccgtggcaatggatatcgatgcggccggactgccgtttttaaagaatctgaccccaccggccggaagcaaatcggtggaggatctgcgtgaagtgaaacaggcggctgggctgccgtttatcgtcaaaggaatcatgaccgtcaaaggtgccatgaaggcaaaagaagccggggccgatgcgatcgttgtgtcaaaccacggcgggcgtgttctggatcagtgtcctgccaccgcagaggtgctcgaagagatcgcaaatgcagtcgatggctccatgaagatttttgtcgacggaggcatccgttccggtgtggatgtgtttaaggcactggcactgggagccgatgcggtgatcattgcccgtccgtttgtgactgccgtgtatggcggagcgcaggaaggcgtcgaggcttatgtcaataagatcggaagtgagctgaaagatacgatggcaatgtgcggtgtggcttcgctgaaggagatcacacgggattgtgtcagagtgtgagaattacatattgggaaaggatgaaacgcttgtgttcgtggcgggtgccatggatatgggcgttttttctgttgaaatgagaaaatggatggattttgttatattttttgctgaaaaaggtcggttgatgtaaaaatgtgatataatagaaaataagggattagggaagaaatataggaaagtgtacggtttatgggacggaaaaagaagtagtatataggaaaaagcgtcctaaaatgaaaaattaaacctgtactttgacaactgaaaatggctataaaaggtctagtttactttttctacagccctttccaaggcatgatatattggttatatcgattactatctgctgggaaaggagcagatatgaattattacaatgctagcggacaaatggacctgtcagatcgaatagcaatagaaactgggatatgcatcggggagtcattcaaaaaaatagcaaaaagacttcgcagacatccatctactattgcacatgaagttaaagaaaacagaaccttcattaaaggcaattacccgaatggaaaagattgccgcatggcaagacaatgcacagtaaggaatttgtgcggctgtgatgaagaagcctgtaatacaaagtgtagactttgcagaggagtggattgtaccaaggtatgcgatagatatgtatcagttgcttgccataagtttgattcgcctccgtatgtttgtaataactgtaaggataaaaagctttgcaacaaagataagtatatttacagtgcgaaattcgctgatgcagctgtaactcgtcgtagatcggagagtcgacaaggagttagactttctgatgaaaagaaggaagaattggatgaacttgtgactcgacttgttaagaaaggccagcctttaacacacatatatgcagaacatgaaaatgaaatgccagtgtgtttgagaacactttataactatatcgatgaaggtgccttatctattaaaaacatagatttaagaagaaagacaggctacaaaccacggaagaaaaagtacaacgatatcaatggatttcactcaatggagtatagacagtgtaggacatatgaggattttgagtatgcgatgaaattcaaatattcagaagatgaagtaacagaaatggatactgtaaaaggcgttagagaatctggaaagcgtttgcttacaatgatctttagaaagaacaacgtaatgctactattcctgatgccagatggaaaagcagaatccgtaaaaagggttctggactatctcgagacaggattgggaatagatgtttttagacggttgtttccggttatattaactgacaacggcagcgaattcaagaaggtagatgagttagaacttacgctggatgaggatggcttcctagtttatagaacaagcctttattactgtgatccaatggcttcatggcaaaaagggtgtatcgagaagaatcatgaatttattcgttatgccgtgccaaaaggaaaaagcttaaacccatacacgcaagaagatatgactttattaatgaatcatatcaatagtgtaaaacgtcctggacttggaaataaaagtccatacgagctcgtagaagaggatgatgaagatttcaaagcattaatgtcattattaaaaatgcacctcatcccgccagatgaagtgcatttaatgccagatttattcgttaaaaagtaattagaccgaagctgcagatagtaatcgatttgtcaataggtattaaatagacgggtcgcatttacttttgcataacaagtagccagccgtctgttaatcatgcaaacaaatatatacctgctatctggaatgccttaattatagcatgatatttgaatttgaacatccattattagggctttatttgacctcagaacagaattttgattattagacgtattttcagttgggttttagtttttcattcaaggtttaatatgcgaaaaaagaagataatggagcaaagacaaatattttcatatgatgattgggaaagactgatattcgaatatgataatgaattgaaaaaattgagaaagaagaaaataaaatcgaaaatattctgaaatattataagatatattattcagataatatcgaaaaatatagatctattttggaaaaacaggtaatcacgtatgataaatggattgtaacatataaacaatataaggaaaccctttttgaaaaaaagatgatttcaaagaaaagtataattaagtatcaaaatagagtgattaaaaataaagaattaggacaaaaaaaatatgaaatttggaataggatggtatggaatgagtttgaatatattaatataaaaaattacaattttttaattgatcagaagtcaaagttacagaataaaattattttcagtgaaaaaaaggaacaaattgcaaaacaactatatgataaggtaaaaaaacagcttgatgagcacataaaaaatgtatttggcggtattacaattagtcagatatattctaaaatagaaccacataaacgttttacacatttgcaatataaagtaagctttagtgaagacagcttacctgaattgtatataaaagtgataaatagtaaaaatgaagagattatgccggagttattttttagctcggcgcaattaaatactgttgctttaagtgtttttttgggtggagcattatgtgctgagagtccaaatgtcaatactatttttatagatgacccaataggacattttgatgatttaaatgtgttatcatttgttgatgtgttgcgaacaataataagtaatacggattggcaaatttttatttctacacatgaagaacgtttttatgagattatgaaagttaagctaaacccacaatattataattcaaaatttttgaaatttaaagaagagggaataattgtggaggatactgaatggcaagaatgaatgtattatgtggataattatgggttatttataaaaaaattgaaggatttttgtttggaggataacaaaaataaattagaaataggtaggatatacttacttatcaggctttctacatttggtggtgcgactcctcttagaaaatcaaaacagattttcattgcgagagaaaagttgacttggtactcatatttgcgattcctgctttttactggtacatgtaaaataattatggaacagaaattgtacaaaatgagcttgctccacagttcaaatgcaacatactctgtttttttagagtgtaaattagtagctccaatggtatgctttaggtcgcgaaaagaagtttcgatgccccagcggagattgtaacagtattttatatcgtccggtgtaaagtcttcttcggaaagtgtagtgataatatttttcaaaaacaccatcggatacttcaacgcggacgattcttagtttcagcagatattcatcggaaatatcagctggattaagatagtcgaaagctatgtttttacaaatatagtggtattgtgattctttttcgggatgtttatgtttctttttagattgtgttctggtcagaatcagctctatggttgtatccagtttgtcaggaagagtcccgacaccaagaaaacgctgtacattcaaatccttagcacgaattaaaaaatcaacattattttcgattgcatgggcaaaaacgttgtaactggaaaatcccctgtcagcaatgaaaatgggggacccccataggcataccgatccataagattgcagatagcttgaaactcatttttaagacgcccaggctggacttctaaatcaaggtaccgcttagaacatacctcatataaagagatggtatgaaccatattaaaaccggataccgatttaccatttggttcgtggaaagtatctgcatctttaagatttctggcaatgttaaattcagaaccatcacacgcaataagatagtattttccgcgaaatttttctaaggggaatttaaggttaaattccttgagaaggtgacggaatgcagaaacggaaagtttggaacgttgttgataaaaagcagagccagtaggaactgaggaatcatactcaaaaaatttgagaagttcatgatttaggcttccgctttccatagaaatgatcagatgcatcattttcttaaaatcaagtttgcgtttgcggataaaatccttatctggattttttacaaaagaagaaagtgagcgggacatctcatcaataatgtcccaaagtgtagttttgacaatttcaggaaatgtcataggtaaacctccttgaatcagaatgaaatatagttctaattcaagggccgctctcgttaccttaaaaatatatcagcaacgagagcggccgcacattttgattgatgtgtcaactataatttataaatttttgttagaggtttgcctcatagtgaaccaataagcttaactaagtgacattggtgttgaattgttgctttgttattcttttgtcattggaagctggcggtgaaaaaagcctgtttatgtgtgccagtattgtaatttcccttgttctgacggattattttatgctgtatatgatggagcgttttaattatcttgtgcaaaaacagtatgaggatgcaatgtacagggaagaaatgcactataaagacatctattatgaagaagcagaaaaacagaataaggaagtgcagaagttaaagcacgatatgaaacataaattgcatgaactgtatcatctggtggaaaatagtgatgggcatgaactttcagagaaaatcggtgcgatgtgcaaggaatttgagcagatagatgaaaagcagtattctgataatccaatcgtagattctgtgcttcgtattaaatttggcagggcaaaggtaaggggaataaaagtagaaacatctattcgtattccaaagcagatgcagcttgatcacggggatataggtgtattgtatggaaatcttgtggataatgcggtagaagcctgtagcaaggtgctggagggacagcgttttgtaaagattgaaaataagtaccagtcggggattttgcttcttataataacaaacagcaaaacaggaaagagaaataaaagcctgaaaacaaccaagaaagataatatcagacatgggcatggtgttcagagtgttcgtaaagtggtagaaaaatacaatggaacggtcagttttacagataaaggggatatatttgaggtttctgcaatgctctatggaattgaagtgaaggaataaatgcaaagcgttacacttaaatgtcaatctgttacactttgacggattttcctgtaaagtatgatatagtgcattcatcaaatgaaaaggagggcatacatatatgtcaaaattaagaaaattgatgaaccgactcagtcatggagcattaaccagcgtggcagcacttgcccttacggtaactgcaaccaatatgaaccgttgctgctggtttattttcggacaggacaagttaccggataatgcaaaaaaacttagaaaattttaaggtggtaacagggtatgattgctaaatttgcaaagaagataaatgaaatattgatacaaaaggggattgtgcaaaaagaggatgcagaactgtaccgatatggtatagaaaatggcattgttgttgcaggaaaccttttggcttctggaatatttggcattgtgacggggagaccgggacttgttctggtcttcctgttattttatgcctcgttgagaagctatagtgggggcagccactgtaagagtagaatcggctgttttttgatatcaatggcaattttatttattccggtttatacatatgagcctgtaatgaaaaatgttcctaatgccgtgattttattgataggagttcttgctgtggtaattattattgtccttgccccagtggaaagtatcaataaaccgcttgatgaggaagaaagaaggtattatgcaagggtaacacattgcataacggcattacaggtatgtgttcttatcattttgttttgtctggatctgcaagattatttttatgccgggtatgtaagtatagtcctggtagcagtatttatggttatgggaaagattgcagtgaaacgatatgtgaaatagcaaaatcctcttaaaatgatatattaaatttctgactgcttttacataagattgggctaagatgggtagaaatttactctttgtcgtatttcgtgttgaaaaaatcgtacttcgtgcaagaaatattgaaaaaagtaggaaaaatgatatggttatggtgaagtagtaaaaaaattatcaaggaggaatttatcatgaaaggtatcaaaaaaatttatcaatggttttggcgattgtttgtatcattggtcttttcccgacagcaaaagtggaagcatcaattgtaacggtaaatggtggctatacgacaagggctaatgcgtattcatggggtacatatagtacaacaaatacgataactgtggtattgcccgaaacagaggaagatttttgggttaaatttacacttccgaaagaaaagcgtgtgtatgcaagatgttcttacaatgcggaaaatgaaggtatgtatcttgaaatgagaaactcaagtaatagaattttagatgaaaagtacagccctgacgatgttttggatatggacacggttattccatttatggcggtggcttgtgataatctcacttcttcatcacagacatattatattcatgttaatcgtggaacttgtgagggtacaatgtatttttcactttcgatgaatgagagaattaaaactggacgaggagtgttttcttttagtggaacagcatctaatcctggaaattcatcaataagtttatcaggtgtagattcttctgttcttacattgaatttggcaaataatactacaattccaccagaagccattgttacatcagtaaatacatcaggtactcaatcaccgagtcagggaaatgttcatcatatggtacttcctgcaacagaatcaagtacttggtatacatctacggtagcaagtgcatcgagtggacattacaatatagatgtttcggatggatttcaggcagcacaaagatggcaatttaaatataatgctttagcaacagcaaaatcaacaatgaaaaatgttaaaataacactggaatgggagtacgatatagcaaatacaggatataagtcatattagaaatgtgggtgatattatgaatattttttttaacagccgaatttatgctaatcagtcattgcttaatgtcctgtttggtcaacaacaaaaagcgacaatcagtcgaagcaatggttgtataggcacaagagatactttgacgataagcgcatcaggaaaggaaaaacttacaaaaagtacaagtggaagaacacataatacaagtattgatagcagcattgacttaaagtcctatatagcttcagccaaaaaaacgaatcaggagatcattgagaatgcaggaacacagattaatgcgaaaacaagtgaatatatgagtacaggtaaagcatttagggaggcattaacggaaaagtattctaaacttgccgcagaagcaaaaacgcattccaatcctgaaaattatattcattccaagtattttgataagagttcagagtattacgagactaatctgactgatacagaacgtaggattgcatataattatgagatgcagatgtgccggacaggaaagataaatggtgtaaattatcaggattctttgttcaggggaattgaagtggacggtgacagtgtagattcggataaaatccaatttgaaagagcattgataaattcgcaaatttcaaatattttaaagcaggctggtgtagatacatcttctattacgaaagattgtacttttactgtcgatccatacagttatgaaataacggtagatggcgtggatgaagaaacaaaggtgttgatgcaggatgccttaaatgtaggagataacggaaaaaacctctataagcatatatattattgttcaacacaagatggctgtgagagttctcagataacaaaggaatcaaaaatgaaatacgaagcatatcatcaagtttatagttatacaggatatgaattagataaacttgaggaaaaaaacgggacatattatacggagtcaggagagaatatattagacttagtggataaggctgttgaagattctggaaaagttccgaaagagttcaagcagcaaatgaagaattggatacatgacctggtttcaactatgtcaactaaaggatggaacaatgtgccggatatgactttaagcattttatatggaaagagtggtttaaaggacatgaatcagttgatcacatatcaatatgaagctgatagtacaaacaggcaatggtattctgtactttagaaatataatatttttgaaaaaatatagggaagtgtgtcaagtatagtaatatagttttttagataaaatatatgattcgaaatttttaaattaaaaaataaacaatagagggagggaaagcgttttaataatgaatctatataaatcaaaaaactataaaataaggaattattcatgaaaaagagaaaaatagcaacaatattattggcagcatgtttgctgttaggaaatgtctcagtagcgaatgcggcaagtattgataatggcaataaagtacatttcaatacagaagataacgacacggatttaacattattacaatcgaaaattgcaaccgaagaagtgacttgtgactttacggatgcaacaaatgatggagcaagtgcatatgcagatacaagaagggtgtcaaataaatatatgtggagtgcaagcacgatggaatataatttctctgatcagaaatggacatcgaatacagaaatttttagtacatatgcaaaaacatcagaagggtttgtaatgtctggtttcttactgaatccaaaaggtcagagcaactataattcggcattaagagaggggtatctgaatgattctgcatatgatgaaaatcagggacattattatcaatgtgttgtttcggatgaggactgtaataatattacatttatgttagaatctaatgttaatgtatttatttttgacaatgatataaatttaatatatcgttcatcggatgaggcgggagttaccagttattttgacagatattattcaacaactaaaacgattgcaggaacgtcgaataaggtaattagtttaggtcttattgatggaaattattatattgtttttaaggtaaaagatgcaacagcaactaccggttatcattatggatattatgctggacaaccattgccaatagcacaaacaacaaccttttcggatcttacacattatacaacaataaagtggaatcgaagctcatctagccaatcagcaagtacgcaaacattgaccattaattgtcctagtggaagtgaagatgagtatgcattgacaggtgtgaaattttcggataaatcaaaagcatttgctaataatacatacgcatcaagcattgactattattatacgccagcaactgctagttattcaaaaaaactagcacaaacaggtggttggtggagtgacttggttgacaataatccaccatcaggatcaattgatggaaactatgcaacatctgttacagtacattgggtaagtggtatttcttatgtaaatgctagttgcactacaatgacacagatgacattggattatttagttcctttcggaataatagtgggctaaatatttagaaagataaataaattacggatggtatttttataccatccgtggattccaagaggtgacgataagatgggacactatgtacattatataggtggcggaatagtagatagtaaaatatatgagacaggaaatgcagcaaaaagttttaaatcgccgatgaaagaattaaatgagcaaacggtgttaatagaaaatgccaaaacaaataagaatgatagttatcatcagcatacgaaatacgatgatcaggtagatcgctattacagtacatatgatataggaacattgttgcataataatgaaagttatttagagggaacaatcgattcaaaatatgatgtagattactattctttttcttatccgcaaaaaagtttttactctaaaatgggtatatcttcagagataacgatttcattggaaagcaagaatagtcaggcatataatttagtattgtacgatttatatggcaatcagattggaatagcgacagatgatggacatggtaataaacagcttacggtacctaattgggactgcgttacatcagattatgtgatcagagtagaaaattccaatatgacatcggattccggggaaggttcctatagaataaaaattacggaaacgaaaaacagggatacttcaagtagtaatgtgcagcactcacaagaaatagcaaatgcagataattcagaagaaaaaaatgcaataaagcagaaatatgaaaaaacatatcaaagcgaaattgacaaattacatcagatgcaatttgaagcgttgccggaagatgaaaaatattcgggaacggatagtgtagaagaattattaaataagatgaaaaagggggagcagttaagtgtgtcggaaatggcatatgtgaaaatatttgccaatttatctgattatgagagagcagagaagtcgaattatataaaaaacgatttttatgcagaaatagaaagaatagcaaatgaaaaaggaattgaactgccagatacatcatggaaaattgaaatagatgtatctggaactattacgattaacggggacattacagaagaaaacaaagaacagataaaaaatatgatatcggaaaattttgctgatgatatgtgggaaaaatatattcagacagcagatatttctaacacacaatatagattagtaaatgcttactatgaagtggaacagttcattcagaaagcaacaaatggacagtattcatttgacgatataaacgtagatgacaatgggaagattaccggacttccagagaaaatgtgtaaaataatgaactcccaggaagccaatgcgaaatatgaggaaatacgagataatatctatatgctgacggattataaaaatcaatatggattggaggatattcttgcatttaaggcagggtataatatttcggactctgaggtaagtactgtgggtacatctggcaataatagtgttatggataatgcaggatactataaaaatatgaaaactataatataatgatagaacctaatagaaatggcgggtttaaaagacatgaatcagttgattacatatcagtatgaagctgatagtatggacagacaatggtattctatactgtagcaatataatttggggggaaaatataggaaatgtgccgtcaagatgatggcacattttctatatatatgatatttatttagagcctatttagataatatgcagagtactttatatttatttaatggaaaaataaaaattaccgatatagtaggaagataggaagaaggtgagtaatatgctggaaattgctgtttgtgatgacgatatagcagatcttgagtgtgcagtgaatatgctgcataagatttttacaagtcaaaagattgcttatcatatagagaaatttatgtctgcaaatcaaatgcttgaaaatatcagtcgtattgatatcggaattttagatatttcgatggaagaactgaatggtattaaactggggagaaaattgaaagaaaaatttccagatgtgaaattagtgtatattacgagttatgaagaatattgtatgcaggtcattaacgaagttcatgcattttcatttctatgtaaaccattggaatatgataaattggaaacgcagatgttggaactgctggatcaactgccggataccggagcagaaaaggatttttataaagtgacggacagcaatgggaaagagtatcggtcaatcaaattgaaactcagggacattttatattttgaatacataaaaagatcaagaaaagtactgatagcgttgtctgatatcacatatgagtatgactgcatttttgaaaaactagttgaagaactgcagccctatgattttgttgtgaattgcagaggaaatctggttaatttaaggcatattgaaaaaataaaaggctttaccatttatctggacaatggaaaagaactccagattgcgcaaaagagaagcagcgattttagagaagaagtaaataaatttttgcagaaaaattcataggagaaacgatgaatacgattttactgatattatgtaatgctctttcctgttttatcataagtaccatactgttccagtttatgaatggaaagtataaaaagagtagtcaaagtagatatgtatatattgtgatcgagactgtcacagtgatttttacaacctgtatcaatatgctcaatcattccatattaaatctggtggtctggggcgtgttgacgggggtgatcgcatatgctctgtattatgaggatatggataaaccgttaagacgtatcattgaatgtgaggcattgatattttgcatgtctgtgtgtgaatcattaggagtgattcttttacaatgtattttgcaggcagcagatataaaaaatgtgaatgaaacgatgctttactgccttgaggtaacattttcaaaagtaatacttatttttttgtattatacattcataaacaggtttgtgaaaaagagcgatattccttatgcaaagacaaggtacatcatgtatggaattatactcctatacaatctgattaacatgggtgtaattgtagagaattttaaaaatggagaagaaaattatttatgtgcagtcaatatggggtgtattgttctggcagatctataccttttatattttgttaaaatggcagatgaaaagaactattatgaaaagcagctcatcgctttagagcaacaggcaaaggtacaatacgaatactatttgacgcagacaaaaaaatatgatcaaaccgtccacatattacatgatgtaaataagcatattaaagcaatcgaaggattatatggtgcagagcaggggaatacggcaggagaatatgcagcggaaatcagagaactgttaaagccgctcattccggttcaatacacagaaaatccgatcttgaacattcttcttaccgataaagaatccgttatgagggaaaaaggtatttcagtaaccataaaggtggataatgtgaatctgaatttcattgaaccaatcgacattacaactatttttggaaatttattagataatgcgattgaggcagcagagaagctggaaggagagaaatatatttcgattaagattggctcataccataaaatgatagctgccagcatcgaaaataactgcggagaggtaaagtggaaaaatggttttccggtatcagcgaaaggaaaaggcggtggaataggactgctgaatgttcagagcagtgtaaaaaaatatgatggaaatttaatattgaaaagtgatggaaataaatttattgctgagttattcctcaattcataaaaagagcattcgtgctcttttttggtaaaaagtcttacttcgtgcaaaaaaatcgtacttggtgcagaaaaggtaaaatattagaagtgggttgtcgatagaaaaagaaaaataaagcggatgatagatataaaaaatttaatgatgggaggtttcgattatgtcaagaattacggactacggttttttatttcaaacaacatttggaacatcaaaaacaaatttggtcaacaatattcagttgtcccaaatgaacagcagttctgtacagaaacaattaaaagcagcagggatcgacacaaacagtaaaaagtataaagcagcactgagtgagatgatgaaaaatggaaacggtgcaatgtttacaaatgttcaggcaattaagaacctgatgagccagtatgacaaaaatggagactggattgatccgaataccggattaacaggacttgctgtaacggatgagaacagaaacagttataaacatatcatttctattccagagagcagccgggaagaaatgtttgaactggcaaagaaagaattcttaaatgaaaacggtactttaaatggtgatactaccaaaagggagagtgtatataacaatttatacagaaaaatggataaggatgaccgcttatcagcaggctggacaatggaacaatatgaacatcaatacagacaggcatttgcagaagcagcaaaagccgctgatcctacatggaaagctgggaaaccaataccggctggtgcattggatggcattacaagagagtcggtggagagtggcaggaagtcagtagatataaagttatagatagatttatttgtgagccacgaggtgaaactaagataatgggttttaaggaggaaaaataggatatgaaaatatctaattacatgaacaatgcgaatttgattgtagaaaaaaatgctactaaagccaagaaagaagatagtcaaacaaacgaaaaacatacgatggaacaatccgcaaagctgtctatttctaatgaggcaatggagtgttatcgaaatcgcatacagcagaacgggcaggaaacctatgatgaggtacttcagcggagagaactcttaaaaagtggaaaaatcaaagatattgattatggttatgagatttcaaagaaagccgcggaattgaacaaagatgctgctaatgctgggcaaaatgctttaagcactacagacagagcaaacggttatgttgcagcatatgcagagttgtatgatgaaattgttcaaggatatgaatcgggcacaagggaaatatatgtcacagatgaaaatggaactcataagcttacaaaggatgaagagttaagcaatttagatgctgcatataaaaaaacagtggatgactttgtgacaatggagacaacaaatcagcatgcccgtggaattattggtgaagaaatgaataaaatttcaaaaattaccacaaggtcaactttggcatcggcttacattgaggatcaaaaaaccagggggaaggatgagattactgaaaacttaggaaagaagatgtatggtgcaattacctcatttaaggagaaatatacaatgattcagcctggtaaagagcagttatcgcagttgttgatgagcattaagatgtaaaagattataagacttatataaggcagggggatagtatggttactgtaaataattctgactattataataacattccagcgggcagggatttaaacaacctgcccaatacttccagtactggtacaactgtaggatatcagtatgatggacttacagaggaagaccgtttcgtacaaaaagttatgcaggagcattatgataaagtgtacaaagaaaatatgtcacattccgatccaatggcgtatgtcatatcgaaatattgtgatgtgacttcacctaatttttgctcatatatgacagaagaccagcgttccatagcttaccgtacggagaaaagaatgttacaatccggaggaaaacctttgggtggatttgcacggtatgattatgcattaaggaattacaaggatgtatatacaggtggttcaagaagtgttggttatgtacgcaatactgacagggaaaaacagtatgccagaagtgttgtaaatcagcagatttcaaatctactttcaaagaatgggatatcaatatcaaaacaggcagatctggtattttctattgacccatatacatatcagctaacagtgtcgggaaatgcagatagaaatacattatcgcagatagaaaaattgctgaatgaaggagataatgcaaaaaatatttggacgcatgcgtggatttgtatgcatgatgcagataatgaaattgttaattcgcaggcaaatatgacaaaggcaaaccaatattctttatggcatgaagtgtatgagacaaccgggtatgatgcacgcaatgcgacatataaaaatggtacttttattgcagaggatggtacagatttacttgcattgtttaaggaaaaatctaaaaatggtgcagggtatgaactttattctaagagatggctagaatatgctaagaatggctggaagaaagaaaatgatttagtgttgaaaataggctttgacagcagtggattgtatgatatagggcaggaaaaaggatatggagcagcacagaatatgtggatgaaaggtgttagccaaagtatgtttgaagctagagtgtgaccaatggacgtatttacgcattgtgattttacgcatgcagctaagtaaaggtgtatgttacactaaataaaagcagggaactatccatatccatgcttcaaactggagataaagctcgtggatctgccacgggcttttctcatattgttatatacattttgctgaaattttaaatttcggtgtaaaagtagattggtgtttagaaggaatatgcaaagtattacacgaaaatgtcaaaggattacagcttaccaaaacccataataatttctgatataatgcgataagtcagaaaggatgatggagctatggggaaaagagagcacatatacgaaattattgcagagaatatcagaaaagaacgcagaaggcttggaattacgcaggcagagcttgcagaacgggcggatgtatcattggatactatcaaaagtgttgaaaatggcagaagggcaatgagtcttgatacatatttgaatattgttcatgcattggagtcatcgcctatggttctgatgagccagcagcacccagaaaaacacattgagcgttttgcatttatgatgaatcggtgtgacgaaagagaaatagaatttgcattacatatgattgaacaaatattaagaggacaggaagattatctgagtgaatagacgggtagttatcctgtcctttgtctatgactcttttgcaaatttttcagcgagatggtatatgatttcttcaatggtgggagtttcattttcacatggaaagtctgtccagaagcgttgcatttgtggatcagggctttttaaagcaatagaaactgcccgcccaatttcctgttggacttcttcttttgtgattccttctttttcggcaatgatttccaaatatttatcaacagagtatgtgcttttatcattcatagtgttgttgtgaatcctttctgagaagggtatctgcgggcaaattgtcaggtgcttgaattgtcccggttgaataccataaaagtaaaacagataatccgttctatattacataataaccttgagagctgttttctatgcagcttatggctattttctattctatcatatacatacagtatggtgcatacacgcaccatatcattataggacactcttgcgtagaatacaaggaggaggtctttgtaatgatagtatatgacaggttatggattacactcaagaagaaaaatattagccagtatgcactaattaaagattatggaatagataaagcacagttacagcgattgcgaaagaatatggtcgtaaaaacggtaatccttaacagattatgttccatacttgattgtaagatagaggacatcatggagtttgtgccggatgaggatattaagtaaagagatatttccaaaatgtaatgagagtttggaaatatctctttttttaatccgcgaatatttatattcttggtatattaaggtgtacaatattccatttgaaatagctggtttagtcactctgacaaaagattcgcttacggtacaatgaatacagcttaagcaaatatataaggtgccggaaaagagtggaaggtgtactacgatattgttaatagtggagaaagaataaaagagttgcgtgcggcaagaagaatgacaagacagcagcttgccgagcagattggattgtcagtggatgctctgcggaaaattgaagctggtgtaaatggagcaaaaatagatacgctgattagtattgctgaattgtttcatataacgttggactatcttgtgtgtgggtgtgaaagaaaggcagaagtcgatgatctgctggttggtctggaggagaaggaagtacagtttatccggaatatggtattaaatgccgttgacaatatgaaacttctgacagaataaaaaagtcggattgcatttttgatgatgcagtccggctttttttataaggatttggaacaggtgggagtgttactcttagttcaaaagagtgtcggttactgtagaagatgcgtggtgtcagttatactctgttcaggttctgagaaaagaaccgttgaatattgaaaacagaataggacacgcatatcccacgagcttatatcgccttgtctatgacagggtggcagaatcccatttcgtgcgatgactatcctcagagctgtagccgattatgagaaacgtaacagcaggagcctttaaggataagagcagagggttgtgcctaccgggttagcagccggaggtaatgagataataagtgcacctgaatttcagcaaaacgcattttcagagagtggctactttcgtaagtccagatgggcaggaaactacgaagtgattgtggctggcaaaggatatgttacccgatacggggatggttaagaaaccgggaagatagtattttatcttcccacacaaactgatttatggtcaccgacagaaaagaaatgtttaggtgtgatggtgtggagagtacagataagtcagcttatgtgaggagataaagtgcgcacagtatcaaatcaatattatttataaggagattttaagatggaaagagcaattatatattgtgcaaaaacaggattagaggctacagatcattttgtgccggagctgcttgaaaagtattgtaaggataatggctatgaaattgtagctatgctttcagagcctgcttctacagaaggagtttcatttccgatgaaatatgcctttatcggtttaaatatggaggaagatgttaatacaatcataacactttcaaaggatatgattggtgcaacagatgagaccgttattgatacacttggaaaactcagcgaatatgatatctatgtggaggatattaatggagaacttgaagagtgttatgagatgatgtacaaagagcctgttcaggaaagtgatataagagggctggtgcttgatacggtatcaatgttctatcataacatcagggacggcagataggaggcaatatgcaggattccagagaaaaaaagcaatgtctgatatttgtaaggaataatgcaaatgatacagctgaccgtatcgaggcatatgcaaaaaagtccggcatgaaagttgttgagacaatttttaatacagataaaaaagcggttgaacgattaagatattatattgaaagagatgtcattatctgtgtgctagtaagagatgtggtagacatttcaatggaacttaatgagattaaagctgtaatgacacttgcagcggaacatggaatcagtattaatgcagagagcaggggctatgaacctgctctcatttcttatgaatgatatgacagaagaaaatagaaaattaaaactgattatatttccgggcgaaacagtagtgattgatgaatatgggaaacggattgttgcctgtccgacagaggatgaggcagaagaatatatcagggaacaggaggaatgacatagatgaaactgaacaggggcgacattgttattgcaaatctggagtcagtaagtaaagggagcattcagaagtatacaagaccttatattattatctcaaataacaaggcaaatcagtattcaccggttgtcacagcagtagccatgtccacaaaaacatggaaaaagaaatatctgccaacccactgtccaataccggctgcaaaggtaaaggttactgacacagattttgaggtatttgacagtatggcattatgtgagcagattgtatccattgatgtaaatgtccatattgagagggtagttgcttcaatttcagatacggaactacttgataagattactgaatgtgtaaaaatccagattggggcatatgaaaagtacaattaaatattaccggggcatttgctccgggttacatagccacctgtattctatgggtggcatttttactgaaagggggatagattttatgacagcagaagaatacagagcactattagatgtggattttaacaatgtaaaaatagaagatctgactgatattagaaaaattaaaatagataaaaatcagccacagagtaagaggcaggcacagttcttaaaacaggtgggaaatccatatatgctgcgtcgtggaagtatgatgattaaggtaagctttgcgaataatggactgtcgatggaacaggcatttgaaaatctgcttttgaatgtctgaaaatttgtggtggaatttcaaagtgatatgtgctatgatgtttttggtataaaaattctaaattagtgcatatcaccttattgaaaagttatcttctaacttaaacaacaataggaggatgtgcatatgagtcagataagtcagatcaaaaagatctatcatgcagccatctatgttcgtttatcgaaggaagatggcgctgttgcttcacatgaaaaaactgagagtaacagtatcgcaaatcagaaatcactgattagagattttctcgaaaacaaaaatgatattgaggttgtgcaggagtatgttgatgatggtttcagcggctctaattttgagcgaccggcattccagatgatgcttgaagatattaagaaaggcaaaattgattgcgttgtcactaaggatctgagcagattcggaagagaatatatagattcaggtatgtatattgagcgattattccctgctatgggagtaagatttattgcaatcaatgatggtattgattccggagaggcaaagtcgcagtcagatgagattattattccattcaaaaatcttattaatgatgcttactgtcgtgatatttcaattaagatacgttcacatcttgaaattaagagaaagcagggagatgtaatcacggcatttgtgccatatggatacaaaaagaatgataaagataagcacaaactggaaattgatgtatatgcagcaaatgttgtgaaagatattttcagaatgaagttgcatggaaaaagtcaggatgcaattgcatgtgaacttaattcatcaggaatacttccaccggctgagtataaagcaagcacaggaagcaattatcagacatgctttaagacaaaagaaaagtcggagtggacttcagtcatggtaaggagaatccttacaaatgaggtttatataggtaatctcgtacagggaaaacagacaacaccgaatcacaaggtcaaaaagaccataatcaaagaaaaatgcgaatggataaggattgaaaagaaccatgagccggttatcacggacagggattttgaagtagtacagagattgcttgcaatggatacaagaacatcaccggacagagaggaagtttatccgctgtcaggggtagttacctgtggcggctgtgggattcccatggtaagaaaaacttcaaaagtgggtggcaaaacttatgcctattatctgtgtgcaacccataaggattcaaagcagtgcagttcccacagaatttccacggataagttggaagaagtggtgctagagcttttacagacacacattgataacatgattgaccttaaaagaattctttcttttatcggcaacgtgccgtttcagcagcttgatatgaaaaagcttgaggaaaggcgtgaaaagaaacaggcagaggtagacagatgtgcagacctcagaggaatgctttatgaggatatgaaggatggcattatctcaaaggaagattacaaagagcttcatacagcatatgagcagaggaaaaagagtgccgagattgccattcaccagattgaattggaaatggaagatgtgctgaatcgtaagagcaaaggctttgtatggcttgattattttacggaacataaaaatatcgagaagcttacaagggaagtggttgtatctcttatccgtgaaataaaggtatttgataaaacccacattgaagtagtgtttgactttgatgactgctacaaagaatgtcttaatgttattgcaagtcaggggcattcggttgaggtggacagtacaggaaaactgaatatcagattaaaggaggctgtgtagtatggcaagaaagagcagaaaaaatatgccggttgcagttgcagagccgactgacaatctgacggcaaaagcagttttaagcatggataaggaggcaaaaccatatcaggttggaatctatgcgagactttcatttgaatcagaggcgaataaggaaagagatactgtagacacacagatagcatatatcagggaatttattaattcgcaggatgatatggtagaggttgaggtctatgccgatatatcggtgacaggaactacttttgaaagaccagaatttgaccggatgattcaggatataagggctggcaggattaatactgttattacccgtgaccttagcagacttgggagaaattatgtggaagcaggcaactacattgagagggtatttccttttcttgatgtgagatatattgctatcacagatgattttgatactgcaagaccgggaactgatttatccgtaccgcttaagaatatcgtgaatgaatattattcaaaagatctttcaaagaaagtcgaaaccggaaagcatagtatatgggcgcagggaggtttcagtgaaggaaccccgccatatggctattacagagccacggatggttcgagaaaacttctgattgatgaagaagtatctgacaatgtagtcaggattttcaatatgtttctggatggtgaagggtatggcagtattgcaaagaccatgcaaagcgaaggaatcctttcgccaccgaaatacagattttacaaagcaggaaaaactgagtttgccgaaaaagcaagggaatggcattattcgcatgtaaaagagatacttcagggagaatactatattggaaatattgttcatggaaagcagaggaaggctcttgatacgggaagaaagaataaaaaaacagacaagtccaagtggcagcgagtagaaaatgctcatgaacctatcattgataaagatactttctatagagtgcaggaaagaattgaacttataaggagcaagcatttggaaggatcaaagcctaatcctgaagctccaaagaagccagataatattctggtatataaaacaaaatgtgcctgttgtggaggaagtgttttgattatcaggcatcacacttattcggacaggttcatgtataagtgcagtaagcgtaggaaattaactgcattgtgcgagaataaatcgtcttatgaatacaatgaggttatggacagcgtattttccgttatccgtcagcacatgaagttgtgtattgaaaaaacaaaatttgttcagaaaatgaacaacagaaaagagaatatcctgcaatatgacatttatacaaaacagatagcaaagcttcaaaatgatgtgagaagaattactgctaacaaaagcggattgtatgaagattacagggaacagcttattacggcagaagagttatgccagtatcagaaagagtatgaaagcagagtaaatgagattgaggctcaaatcactgagctgctttaccgcagaagtctctatgagaaagattttcacattgatgaaggctgggaagaaaccgttaacaagtatttgtcaaagaggaaacttacaagggaacttgtggaagcgtttgtatcagaaattgtatttactgataacaatatagaagtaaagcttctgtatgatgatttcctcaaggaactgcttgaggtggcagaagaaagagaggtgagcagcaatggataagacgatagctctctatatgagattatcagatgaagatgacaacttggctgctcatgaggaaagtaacagtatttcccatcagcgaaagttaatgcttgatcatatccagaaactgcctgaactaaaggactgcaacataatggaattttcagatgatggatattccggagcagactttagcagacctaattttgtaaaaatgatggatctggtaaaggctggtaagattcaggttattgtgacgaaggactacagcagactcggacgagattatcttgaagttggtaactatatggaaacattatggacaaggacacaaaaggcagaccgagaaacgggggctgctgacaacaagtaaaggctgagtatcaagcaccgggaaagtgcgggatattcagcctgttttgttgtcaggggtttccaaaggggcttgccccttggcacacgactttgcgtagcaaagtgtagtgtgttatacgctctgtcggcgttgccgtgaaaataccgttgccgccggggagagcaagggcatttgaagcggcaggaaaacagggctgtgattgcgtggcgtggagccgcaagcgcaggactggtttcagcagcagacagggcgtatatgaaagccccgtccctcgtcctatgccggactataggacaaagtgtcccagccggatagccacacccacgaaaaagcggacggactttcttctcaaaatcggaatgggcgggaaagccattttagggctttcccgccttgattacccatcagcaaagacgggcgaggctgtcaacggcggcgcatttatgcgccgttcatcttgaccgttgactgacacggctggctttgctatccgttcctaatctgtatgtaatcaatataatttacgaggaagatttccaaatagactgtctaattcttcatgggtcattgctctaataagtgcccaattatcttttttcataagaataaatggttcaagtcgttttatggcttcgtggtattccatttgcccgataattccaccttgtggatttgtaaggctaaccattgtaataatccattcgctaattgtcttgccctctattgcccactgctcctccggcacgattgggaaaagagaatcggtatcttctgtaagcgcaagccctatcaaaagtgtaccatcttctttttcgtaacacttaggattagcttgatatgcttcttgtaaaagtttttcaatatccggctttgttagcttactatttgtctgcgagttctttttcttaaagaaattcatgtttttgatttcctccattctgtaatttcatatttattactttctccctcgctgtggggttggatttttcagcaagtccgacttctgtgcaatctttttcagccacttcttttcttcttcggacagcttcttcaaattcaatttgagccgcttacagataaacgccaaagctgcttgctccggatcgctgtctgggctggcggtttcctcggcggtctgcaaaaaatcttccagaggattgtcctccgggacgctgaaaaaatcgtccttatgcgcttcccgcaggtcaagagctatcttgtttatgtcctgctgtatcacatagcggcaaaagctgtcatcatcaatatgggcggcgataagctgtcttaactgcgggtcagacaagccgggattgtgctgcttcataatggttgtgctcacagcgtctacaatggcgtttgcactctgcacctgtttgccagcgataccgtttacatagatttcaaggtcagccatgagctgggggaaatccgggtgtgccgccagctcacacaagagggaattatccacccgcccacttttcaatagttcaatcatatcatcgctcaaacgcaggtctgcaagatcggcgtttgggtgatttcttgtttgggacagtcccagcagataatcggcggtcacgccgtaaaacttcgccagcttgataatggcatagtggctgatgtccttgaagtcctttgcttcataactgcccaacgcagacttggagagatttacctgttcttcaagctgctccagcgtcagcccacgctccacacgcaggtcttttagtcgttcttgtatggataattccatgcgctccctccttgtctgcccaataaatgggaagctatcgcttacatcatataaagaaaaattatattaaattctcaataactgtttccgtcattttcagtgcttcggtaatgttcggagcgacataatagataaaatccgggtcatgcacataacaaataatttgaccgatttcacctttctcgcttgggttatagtccaacatcagataaagagaaccggcatactcagcaaagggaaaccaacgctcacaaaacagatatggctttatgcgttcgtctaattgttgcagttgtttttcaccaattacatttggaaactctgtcattttacagtttttattttgaaaaagagattttaacttgattatttcttttagtgacagtaggcgatacccgcgataaaatccctcctgcggccaaattaagctcatatagccgctgccgtttttgtatgaatatacggttttaaaatcctctggcaatcttatttgaaattgattttcaaaggcgcttaattcttcttttgtagcaccttgaattttaagatactcgtcaatatcttcctgttctacttcctcatcatttagtgcttcagcattttcaaggagaagctgctcatttctcttgacaagttccactatgctatccattttgaacacctcacaacttccgatttatcgtcttgtatttattattttaccacaattccgagagcgtggaaataaagagttttccgggctgatttccgaccttatggatatacggggcgggcggtcttttaggtgtagacttagggtagttcatcgatgagctgcaccttgaaaaatgaataaccgtccgaaaaggaataccccggcaggggaagcaccgcaacgagccacttcgggacaaaatgtcccgaagtccggggagcgtgccaacgccggaacacgccgcaggaatggggcaggaagccttttcggggagaacggctaaggaaaaatggagggaacacatgagagagaacccatataaacgactgccgcccatagagcgcaggcaggacggttccctttaccgcatgacaccggcacagaggaaacaggcaaacgccctgatctgccgggagtgctgctgttatgaggatgggaactgtatgctccttgacgatggggacacccacacctgcccccagactatttctttctcggtctgctgtaagtggttccgctggtcggtcttaccgcaaatcggaacgctggaagcagagattttccgggataaggagctaaaacgctgtgcggtctgcggcagagtgttcgtcccaaagtccaaccgggcgaaatactgtcccggctgtgccgccagagttcacaggcgacagaaaacagaaagtgaacggaaaaggaggtcttgtgtggacagttaggggctgaaaagtccttgatttacaaggctttgcaagcacagaacagggacaggcaatagaaactaccgtctgccccaggaaacaggcttctaaccgtccacaaaacacgatatgacaaacaccatttatatccatcagccggaaaaggcggtcagctttacccggcttcccaattttctttttgaagcccccacattcacgccactgtccaacgaagcaaaggtattgtatgcctttatcctacgccggacagacctgtcccggaaaaacggctgggcggacgaatatgggcgcatttacctctactatcccatcaatgaggtagtggagctgctccactgcgggcggcagaaagcggtcaacaccctgcgggagctgcaatatgccggactggtggaaatccagaagcagggctgtggaaaacccaaccgcatttacccaaaatcctacgaagcggttccaaacaccgacttcaagaaatcccattccggtacgccggaggactgaaaaccgcactccacaagtacgataatcaatcctcttgaagtacggaaaccggacggtatatagaaatacagagattaaaacgattttatttatatcttatccattcctatcctatccgagatattttctgcgggattttcctgtggaaaagtcccggaaaggaacggaatggggaaaggagtttcatggcacaacacgcaattttgcgatttgaaaagcacaagggcaatccggcaagaccgctggaagcccatcacgaacggcaaaaggaacagtacgccagcaacccggatattgacaccagccggagcaagtacaatttccatatcgtcaagcggtcgggcaggtactaccactttatacagaaccgtattgaacaggcaggctgccgtacccgcagggacagcacccgttttgtagatacgctcataaccgccagcccggagtttttcaagaagaaatccccaaaggagatacaggcgtttttccagagggcggctgatttcttaatcgggcgggtagggaaagaaaatatcgtgtcggcggtggtacacatggacgagaaaacgccccacctgcatttggtctttgtccctctgacagaggacaaccgcctgtgtgcaaaggagattatcggaaacagagccaacctcacaaagtggcaggacgattttcacgcctatatggtggagaaatatcccgacttggagcgtggagaaagtgccagcaagacaggccggaagcatatccccacccgtctgttcaagcaggcggtcaatctctccaaacaggcaagagccattgaagccacgctgggcgatattaccccgttcaccgccggaaagaagaaagaggaagccctctccctgctgaaaaagtggtttccgcagatggagaacttctctgggcagctcaaaaaatacaaggtcacgataaacgaccttttggcggaaaatgaacagttggaagccagagccaaagccagcgaaaaaggcaagatgaaagatacgatggaacgggcaaagctggaaagcgagctggacgatttacagcggctggttgaccgtatcccgccggatatactggtggaactgaaacggcagcagcggcagcatggaaaggaaaggtgattttataagtaccactatcagatacaaaaaggaaacggaagtcgtgacttttcaaggcagggaaatcacgctggaaaacctctccccggtgttcacgccggaacaggaagcggtcaaacgccgggaactggagcagcagctttatgaggtgttccgcaaatatgccgataagcggcagaaagaggaagccggggcataaggttttccaaagccatcgttgatttgcggagctgctggcggtataatgaaactgtcagcagctccgtttcttttttaagaaaaggagcgacaatatgaacaatcgaatagacgcaatctatgcaagacaatcggtagacaaaaaggacagcatttccattgaaagccagattgagttttgcaaatacgaattgaaaggcgggaactgcaaagagtacaaggacaaagggtattccgggaaaaatacggagcgtccacaattccaacagcttatgcgggatattgaaagcggccttgtgcggaaagtggtggtttacaagctcgaccgcatcagccgttccattctcgactttgcgaagatgatggacttcttccaaaagtacgaagtggagtttgtgtcctctacggaaaagtttgatacctccaccccgatggggcgggcgatgctgaatatctgtatcgtgttcgcccagcttgaacgggaaacgatacagaagcgggtgcaggacgcatggtactcccgctgtcagcggggcttcaaaatgggcggcaaaacgccctacgggtttcggacagagccttatgtgatggacggggtgcgcacaaagaagctggtaatagagccaaccgaagcggcctttgtccggcagatgtatgagatgtacgctgacccgcaggtatcgctgcatgacattacaaagaagctgacggcggacggtatgcgtacttatcatggcaggccgctgtcaagggctactttgagcgttattctccgaaacccgatttatgtcatggctgacctcgacatatacgagttttacaaaagccaggggacggatatttacaatgatgccgccgactttgccgggacaaacggctgctattactatcagggcaaggggaatacagaggacaagcacaagcacctgcaaggacagacgctggtactggctccacatgaggggtttatcccatcggagctgtggctgaaatgccggaagaagctgcttgccagccacacttaccagcccgcaaggaaagcccggaacacatggatggcgggaaaaatcaaatgcgggaaatgcggctatgcgctcatgtcggcgcactctaacggtattctttatatgcgctgcaccgttcatgcggacagcggggcctgccccggctgcggctgtgtaaagctacacgaactggaagcggtggtctatggggctatggtgaagaagctaaaagattttaagacgctgacaggccggaaaaatgcggcgaaaatctccccgaagctggcggcaaagcggctggaactggcgcaggtggaaagcgagattgaaaagctgcttgacacgctgacgggcgcaagccctgttttgctctcctatgccaacagcaaaattgaggagctggacgcaaggcggcagtccattgccaatgagattgcaaaactctctgcggacgctgtgccgatggagaagatggaaagcatttccgggtatctggatgactgggagaatgtcagctttgaggacaagaggcaggtggtggacgcactgataacggtcatccgggcaacaaatgaaaaggtagaaattgaatggaaaatctgacgggttaatccccaccgtacctatcctttttgtgctcttgtctataatagtgaatgtatatttccggttcttcaggtaagatatatcagcgtgaatgataattacgattctgctaacagctttggttcaaccggaggtatgagtgttgcactgaaaaatcttgtgaatgcattgtattgtaaggatgcatcaaaaaaggtaagagccgctaaggcagtgttggctaagcagggaaagtacattgctgcatttgctccttttggatatcagaagagtgaagatgataagcatatgctagtgcctaatcccgtaacggcacctgttgtccggctgatatttgaactagctacgaaaggaatgaaatataccgagatagccaattatctgaatgacaatggatatgacagtatatttgaacattaccaaaagttgggtgtcaggagatgctatgagagggatattggtcagcatatgtggagtcccagcaccgttatggggattctgtacaatgaagtctatattggttctgtaatcaacaataaaacagccgataacattgataccggtcatcaggttgtgcagagagataaagaggactggataattgttgaaaactgtcacgaaccattggtgtctgtggaagattttaagcttgctcataagatgatagccagacgtgaaaaatcgccgagaaagcccaatggcaagtggcgtaagtcatatcttcgctgcggagtgtgtggcaaggggcttaataaatatggaaatggttcttcatataggtgtcgtgaaggtcatgtatcacgtattcgtggtgaagaaatagaacaggctgttttggatgtggctagaaaaatggcagtagtccggttggaagagtttgagatacagatgaataaagacagttcttctgatgatatcggacaggaaatagaatcattaaagaaagcaaaagcacattatgcgaaactaaagtttgagatttatgatgattatactaggacaaacataacccgtgagcagatggcaaaaaagactgctgaagtaaaaaataaaatagcagagcttgataaaatgatagctgaaaaacaggagctgtttgatcttcagaaggatttgtttgttgatgcaaaacaggagcaattgacaaagctcagcaagcttgataagtttgatgaagatgtaatccgaaatatcatagactatgtgctcatatacgataacgagcatatagaaatcaaatggaactttgatgactttcacattgaataatggtataatgttagcgttagtaaggcattatatcgaaaagaagtaatactggggaatcttgctaaaggttccccaatatttttgaaaaaataatttttttttgtttcttacttgacacgggcagaagctcatcacgcagtttccccagttttaaaacgagttattcagtattttacgcctgattttttgattggtcttacagcaaccgatcaacgaccagacaaaaagaagttggagacaatatttggtaattataagacaggcttatctttggttgatgcgatgaaaaagaaaattgttgcagaggcaaatgtgtgtcgtattgaaaccaatctggatttgagtcatattcgattcaatggcaaagattatattaatgctgatttggaaaagagtattcgtgtaaagtccagaaatgaattgattgcagatgtgttatacaactatttttcggaaggaaaagctgggcagttgcagggagtcgtgttttgtgtaaatacgaatcatgcacaggagatggagtgtgtattaaatgcgaatggtctttcggcaaaggcatataccagaaaaacaaaaaatccggatgaagttatgcaacagtttcgagagaaaaaaatacgttttttgtgtgcttgtgaaatgatttcggagggatgggattatccggaacttggaattctggtaatggcgcgtccaacactttccaaggttctttatatgcagcagattggtagaggacttcgacgaacaaatacaaaaacaaatgtgtttgttattgatgtagtagatgagtatggtgccatggcaaaaccgtgttccatgcattccattttttctaatccattttacactgcatttggaagtattttaaaaagggattattccgtgggagatatgatagaagtagatggtctgcatgaaacagtagaacgtattgtgcaggtagacattgaaactttcgaagaaaaatatggtgattacttaaatcaggaacagctggcgagagaattttatttaagtacgggaactattaccagctgggttaccaaaggaaaaatttctccggatgaaatgattacttttggaagtagaaaaatttatctttttgcaccagaacatgtgaagcagattcgtgaggaaaataatattccagaacatacagaggaaacgatcaaaacggacttctttgattttgtggaagaacgtgattacagtctttcttacaagatgccgtttcttctttcattcctaaaaaatatgaatgaaattggagatgcaaaaattgataatgtgctcacagattatattgctttttaccaagacaggattgataagggacttccggtagatcggtcaagttgtccatataatgcagaacgattgaaagatcggaaatatattaaaagcaatatgctgacaaatccttttgaaaaatttgagcgtaaacggtttctgtattattcaaaggatttgaatgtgatttctatgaatcatgcgctttttactaaactgaatgaaatagatttgaaaaaggtgaagaagcagatggaagaggatttggaacagtattattcgaaaataaaaatcttatagttaattgaaaaagtagaatgaaaacttttaaattaaaatggtgtggtgtagagtaataaaaaaaggccataggccttaatttaatctgcaccatgcagagtcaaaagacgatgccggataaccttatttgcactcgctttgctaattcacctttattatagcatgtaaatttatatagtcaacaataaaataataaaaattagggaggagattttatggcagcattcaagtattatttgggactcgatatgggaactaattctgtaggctgggcggttactgatccaaactacaatttgtttaaggcaaaaggaaaagacttatggggaatacgtgaatttaatgaggcatctactgctgtggaaagacgtacgcatagaataagcagaaggagaagacaaagagagcaggttaggattggtttattaaaggattattttcatgatactataggtgaagttgatcctgatttttttcaaagactggcaaacagtaaatatcacttggaggataaagatacagaggtaagatataaaaataatgtttttaatgatgatgattacacagataaggattattttgaccaatatccaacaatatatcatttacgaaaagaattaatagagagtaccgataagcatgacgtaaggcttgtgttcttggcattgcttaatatgtttaaacatcgtggacactttttgaattcaggattaggtgaaaatagcggagaaaataatataaacaatgcttatttagaattaacaaatttactttctgaattcacacaatataatttgaatgagacaatcgatggtaaaaaaatagaagatcttctgtcgcgcagagatatgagcagaaccagaaaagcagaaggacttgcagagatacttggcgtggattataaaaataagccatataaagagttgataagaggtttgtgtggcttaaaatttaatgcatgtgcaattttcccggagatacagagtgacgaagtgccaaaattagatatctgcttgtcagaagcatcttttgatgaaaaatcagatgaaatagctaatatacttggcgaagattattttgaaataatcatggccatgaaggacatatatgatattggttcattggctggtattatgaaaggtcataattatctgtcacaggcaagagttgcgtcatacgaaaagcataaagaagatttaaaacttctaaaaaatgtaatcagaaaatattgcagcaaagaggattacgataacttctttaatagtgaggcagatggctcatatgcatcatatgtaggttcctataattcaaaaacaaagcaaagaagagtaggcaataaaagatcatccgaagaattatataaagcaatcaaaaaacttttaaagaatgtacctgcggaagatgcagatgtacagcgcatattgatgtcaatagaaaacgagacatttttgcctaaacagttaactgcatctaatggtgttataccgaatcaagttcatgcaaaagaaatgaaaaaaatactttcaaatgcggaaaggtatcttccgtttttaagagaaaaagatgaaacaggtttatcggtatctgaaaaaataatgaaactgtttagttttcaaataccatattatgttggaccaacgacggaaaaaagcaataaagatggaggaaatggctgggtagtaagaaaggaagaaggacaggttttaccatggaatattgatgaaaaaatagatatgaaagcgacatcagaggcatttatatcacgcatggtacgacgttgtacatatattagcggtgaaccggtattgccaaaatcatcacttgaatatcaaagtttttgtgttctcaatgaaattaataatattaagattgacggagagagaatttctgttcaattaaaacaggatatatataaagaggtatttcaaaaaggaaagagagtaacgaaaaagcagttatgtaaatatttgcatacaagaggaattattgaagcagaagaacaggttacaggaatagatgttactataaacaatgcattaacgacatatggtaaattcaaggcgatattgggggatgatatctctaaagatagcgttcagaaaatggtagaggatattgtattctggtgcacagtttatggggattccaaaaaatttttaaaggatagaatagaagaaaagtatggcgagaagcttacaaaagagcagattaagagaatagtaggttttaagttcaaagattggggcaatttatcaaaaaatttcttagagcttaatggagcggatgtttcaacaggggagtctgtaagtatcatcagagcgttatggaacaataatcttaatttgatggaacttataaacagtagattatataattacaaagaacgtttggctgagtatcaaaatacgatgatgaaaacattatcagatatagaggcagaagatctggatgaatattatttttctgctccggtaaagcggatgatatggcagacaatccttattattaaggagctggtaaaagttttgggatgtgaaccggatcgtatatttgttgaaatgacacgaagaccggatgaacgcaaaatgcgtactgagagcagacgtaaaaaattcgaagaactatacaagaaagtaaaagatgaagatgttgattggatgaaagtaattgcgcatgcagatgaagcaggaagcattagaagcaagaaaatgtacctttatcttacacaaaaaggcagatgcatgtacacaggaaagcatatagaattaagtgatcttttcaataataacctatatgatatagatcatgtatatccaagacattttgttaaggatgataatattgacaataatctggttttggtatgtaaagaaaagaatgcacataagagcgatatttatccattagaggatgaaattcttgcgtcacagaaaaatatgtggtcagagcttagaaggtcaggatttattacagaagaaaagtataatcgccttataggaagaaattcgttcactgatgagcaaaaagctggatttattgcaagacagcttgttgaaacaagtcagggaacaaaaggagttgcaaatatactacagcagcttttaccagaaagtaagatggtctatgcaaaagcgtcaaatgtgtccgagtttagaaatacgagagacattcctaagagccgtctgattaatgaatttcatcatgcacatgatgcttaccttaatatcgtggtaggaaatgtgtattatgtaaaattcacacagaatcctcttaactttataaaaaatgattatgaccgtgataaaaccaaaaataattacaatttatcaaaaatgtttgactgggatgttgaacgtaatggtgaagttgcatggatcgcacagaaaaaggatggtgaggcaggaacaatagctacagtaaagaaagtgttgggaagaaacactccgttgatgacacgatatagttttgaaggaaagggaggtttgacaaacgaaacactttatagtgctaagaaagctaaagaagaaggatacataccttttaaatcatcagatgaaaaaatgaaggatgttacaaaatatggaggatttacgagtgtaacaggagcatatttcttcttggtagaacacacggaaaagaaaaaacgaagccggacgattgagtcagtaccattatatctggctcaaaaaatagaacagaatccacatgagctggaaaaatattgtgaacaggtattaggccttattgattttgatataagagtcaggaaaataaaaataggatcgttagtaaaacggaatggttatttcttctatattactggaaaaaacggtaaacaattaatagtaagaaatgcagtaaatatgtacttgaaaagggagtgggtaaaatatatatctaaattggaaaaagcggtagacaaaaatattgtagaagaggtaattgcaaaggacaaaaatgaattactttattctgaactgataaataaatttaagactggcatttttgcaaatagaccaaatccagttggtgataagttggataaggctaaagaaaaattcctaagtttagatatagaacagcaatgtacagtactatgtcaaatcttacagttatcttccattttgggaagtgcaagtgatatgacattattaggggaatcagcacattgtgggaaaatgcagattagcaaaaaaatcggagatgaagatatatatcttatcaatcagtctgtaacaggattgtatgaaaagaaaattaatctccgaatagtatgagttggcggacagttgtcatctcaaatagtgcaaaactggattatcaaatggggtatttgatagtgagaaatcaggatgttgtaaaaattcatattagtgaaatttcaatattgatgattgaaacaacatccgtttctcttacagcagcattactatgtgagttgacaaaaaagaaaataaaagtaatattctgcgatgaaaaaagaaatccgtcatcagaacttgttccgtattatggaagccatgacacaagtatgaaagtacgaaaacagattgcgtggtcagaagatataaagacatctgtatggactgaaattgttaccgaaaaaattcggaagcaggcggaaaatcttgagagatgggataagccggaagctcagatgctttatgaatatattacacaaattgaatttggagatgcaactaacagggaggggcatgcagccaaagtttattttaatgcattatttggtctggattttacaagatcagccgaaaacagtataaattcagcattaaattatggatatagtctgttactttctacttgtgcaagagaaactgctcttaatggatatattacgcaaattggtttgtttcatgataatatttttaatcagttcaatcttgcatctgatttgatggagccattccggcctattgtagataatctggtaaaaaatatgatgccagaaaagtttgagcatgatgaaaaaatagaaatattaaggttgctgcaaaaagaagtgattatagcagggagaaaggagtgcgtgaacaatgcaatgaaaatatattgtcggagtatttttgatgcacttaatgatggcgatatttcattgataaagttctataaggatgagttatagatatatgagaataatggtgttatttgatcttccggtgctgactgaaagacaacgcagagattatcgtgagtttagaaaatacctgataaaatcaggctttttcatgttacaggaatcggtatattgtaagttagtacaaaattcaggtgttgcagatgttattcaggaaagcatcagaaagaataaaccggcagagggacttgtacagattttaagggtcactgaaaagcaatattcaaagatggaatatgttgtcggtgaaaataaatcttgcgtattggataccgatgaaaggctggtgatattatgaaactggttaatactttgtatgatttagagtttgatttaatagaaaatcaaatactcgttttatcaatagaaaatcatctagtctattccaacatattagagacattatggaaacagtataagggagaaaatggagatttcattttatccgatgaaagcaaggaactgaagctatcacagaaaatggagtgtatttataatatctttagcattaatactaatgatagaaaaatcataacaaaattgtatcaggaacttacatttcaaaatgatacgttactgcaagaagagagcgtcttgtttaaacaggaactgatatcatactttgataaggttgtttctactgttccatataatttaaaatataattttgataccgatttatctagtttaatgaaatctatatcagtagaaattgatgatgactcggactcattacttgaaaaaatgatgcaatatataaatctcatgaatcaaatttgcggagttaatatatttgttattccaaatttaaaagcctatttttcaacagaggaaattatacagctttatgaattcacaatatacaataaaatatatcttattgttatagaagcaatacagacaccgcatattgaaggggaaaaatgctggataattgatgaggatttatgtataattgaattataagaattggcactatattcgcaatatagaataagctcggagatgacctcaaagtgatttgaggtttgagagctttgctaattcaaaaagatacaaaactcgctcatacacctgtttgtcaatcatctcgtttgagagctttgctaattcaaaaagatacaaaacaatattgtagcttccattgcttacctcctgtttgagagctttgctaattcaaaaagatacaaaacattatcgccaatgccgggctggttcatgcgtttgagagctttgctaattcaaaaagatacaaaaccagtcttaagttcctttgtatttattccttgtttgagagctttgctaattcaaaaagatacaaaacaaagcataaaacatttaatcagatagcagagtttgagagctttgctaattcaaaaagatacaaaacccattttccatatgttagtcctccgctctcgtttgagagctttgctaattcaaaaagatacaaaacgaagtttggctcctgtgaagcgaatagtgtgtttgagagctttgctaattcaaaaagatacaaaactctatcacatcgagcggacagaacatcgtgtttgagagctttgctaattcaaaaagatacaaaacaaatgagaaacggctaaacaacgccgaaaaagtttgagagctttgctaattcaaaaagatacaaaaccggaagatgttccccaggatgccgatttcagtttgagagctttgctaattcaaaaagatacaaaacttccggttcttttttctccggttttccgtgtttgagagctttgctaattcaaaaagatacaaaacaacgcgatccatattatagcgcgtgtttcagtttgagagctttgctaattcaaaaagatacaaaatgaaacagctactaagtgtaacgtccagcagtttgagagctttgctaattcaaaaagatacaaaacgtaccacgcacacaaagacaaccaaatgtagtttgagagctttgctaattcaaaaagatacaaaacaaaaacatcaattgaaaaatttggtatgtcgtttgagagctttgctaattcaaaaagatacaaaactttatttcactcattcttcatcactccaatgtttgagagctttgctaattcaaaaagatacaaaacaatacagcgtgtcaggaatattgaatattcgtttgagagctttgctaattcaaaaagatacaaaacaaatgatttaaaaatgatgaagtattattcgtttgagagctttgccaattcaaaaagatataaaataacagtgctgtttgcatagagcccgtcgaccagccattaatcattcactcagatcgtggcagtcagtatgttgcaacggagtataaaaaagcaacagaaaatatgcagcgtagttactcaaagaaagcgtttccgtgggataatgcatgcattgaatccttccattcaattatcaaacgtgaatggcttaaccgctttaaaattcgcgattacaagcaggcataccgtttgattttcgaatatctggaagctttctacaatacgaaacgaattcatagccgttgtaactatatgtcaccaaatgaattcgaacgagtatatgaaagaacacacactgaggctgagcttctggcaggttaaaatgggaaaaaatttctcattttaacttgtactaaatcttgacataggaccagtgattttcgtgatatacaaaggtggtgatctcatgttaacaaatgacaataatgtcaggcgcaatgacttatcattacgcctaaaatacataggtatcaaaaccagaatatttaaaatagctccctttatgtatgtgattttatgttccaatataccagacgattttgaaaaaataaagacatattttgatcgctccataaggtatgttactttgcagatatcattatcggatcaggtgccggaacattatatagaggaactctctccaattgatatggaacatccggtggatgattttcgggcaacagcgaggaccagagctgagatagaagaatatatttatggaagataccatgattttgacattagaaaaattgttccgagtgaaggcggcataaattttcatatggatatttatgttggaagtgatgtgagtgacaaacagatcgcaaggttgcaaaaggaactgacagaagttgactttggaacggatcagattcaggtacttcgtacaacggaccctccggaagataaaacaaaattaaatccgcaggacagtgttatgtggttaaatacgaacaagagttatccgtttacagttgctgagacagatttctggtatgacaatatagaggcaatttatgatggctctgtaaagagaaaggatttatctttttgcagagatggtgaactgaaatgctttgtgaatgcgtctgtttttccagtgatcaatctacgcagccttttattattatatgatacggtgtatcttgctttgccaattgaaaattttttggatgagtttttggaaatgcagggcatgaaaaagaaagagctggtccaacttgtttcaatggggaaagtagttcttttgttaggaaatgatgagacgaggtatgatcggcaggttattttggatgcttacaaagagtcaccggattctgtaattggaagaagagctatgaatgcgatgatgattgcacagctggttgagatgaaaaatcagtatgctgccaattatccgatggcttatgagatggcatcgcaacttgcaaaatatggaaatcagaaacaggatgaagtggcacttcatatatcagaactgttggcatggccatatagagtagtgggagaaagttttggcattttgcaaaattcgagtcctatggcagtcagtaatttcggcattaatcagttggcatataattttttcagagagcatgatcagaagagtgcaattgaatttgaatttatttcaaaggcggaatcggcacatttagccatggctttggatgcaacatattttccgtttcgtgcagaaaatgataataaaatatatacggatgaggcagagacttctatgatggaaggaatgatgaaggtatattggtatgcaccagagcaagtgaagcggatgcagtcgatttggaatacaaattatacagaaagaaatatgctggaattcttcgacacaaaagaaaatattgatattttgcgtactgcaaacatggcagacaagtaccagacacctttgaagttccgggctattttggaaaatctggagaagatggaagaaacagatcgaagacaaaagattcgggagtataataatattttggcagaggcttcggaacgaactgcgaaatcgacaagtattgtcgatttcatgcttggaactaccggtttcttaaattttggatcttatttgaatacgatactgaatttgctcggattactgaaaggcgttccagatatgatgcctggtgcaacggagcgaaaggatttgcaaaaattccgttcgattgcaaaagaactgggcacagataatccggagaaaacaggagaggaagtttatcttcttgatcgtatttctccagtggctaatttaagataaaaagtaatttatgcagactctctgcataaatggattagaacaattccggaaggcattgatttgagaattatttatgggttatactgaaaataaaaattacattattagataaataccaggaggcttacatcatggaacgagtagaaaaattcttaaaagaagcagaaacatattatttagcaaccgtagaaggcgaccagccaagagtcagaccttttggtacagcacacatttttgagggaaaactttatattcagacaggtaaggtgaaagaggtatcaaaacagattcatgcaaatccaaaggtagaaatctgtgcatttaaaaatggagagtggctccgtgtagcaggagaacttgtggaagatgacagaagggaagccagacagtcgatgcttgatgcttacccatcattacagaagatgtattcagcagacgatggaaacacagaggtattttattttaagaatgcaacagcaacattttcatcatttacgcatgatccggaagtagtgaagttctgatgacaaaggacgagtggtacaggcagttgttcgagagactggacaattccaaatttcgaagcagctttcatttgaagcagaaagacatagattacataaaccaaaagggacttgatacgatcagacaacatgcaaaggactttattgcaaagagagaagctcccgcatttatagcaaatgatggcaaacagactcctatgagggggcatccggtatttattgcccaacatgcaactgcaacatgctgcagagagtgtatccggaagtggcacaaaatgcagccgggcagggaactgagtcaggtgcagcaggattatcttgtagatataattatgacatggattcaaaaagaactggaaaggcagaaaaagaaattatgaaaatgcagatatttgtagatgcagatgcgtgtcctgtagtaggtattgtagaagaaatagcaaagaaatatagtattccagccacattgctgtgtgatacgaatcacgtattatattcagactatagcgaagtgatcgtagttggtgcaggagcagatgctgtagattacaagctgattagcatttgtcataaaggggatgtcatagtatctcaggattatggtgtcgctgctatggcacttggaaaaggggcgtatgccattcaccaatccggtaagtggtacacaaatgaaaatattgaccagatgcttatggagcggcatcttaacaagaaggcaagacgcagctcgcataagaatcatatgaagggaccaagaaagcgtacagaggaagatgatgtacgctttgctcagtcttttgaaaaactcatacagatggcaaaagcaaaagaaggtgctcagagtgggattatttaagagaaagacagttacaaagacttatgataaagaaaacaagaagccggtaattaaggcaagcatctgtaacggtgagcaggttgctggttttaaggacatccatacaggtaagatcgaagaggttatgctgattaaaagtcaggcggatcttgacgaattcaagaaaatgtatggaatagatggtgagatagaaaagtattgatatgagcatattaagaaacatactttggaaagcagtttttcaaaattgcaaaattatccctgatgccatttggcgcagaggtaatctgaccggcaggagagcatttttttgtgagtttaaaagaataggcaggaaagatgtgtgacataacaaggttacagatggatgagaaaggaaaacacgatgaacatatatgatgaattggaaaatttaaaagtcagggctcgctccaatccggaacttgcgcaggcgttgttagccacgcggggaatgaaaaatccggtttccgcattctgccgtattgcacaggagcatggatgcaccttttccgctatggatctggtctctgccggtgaggattcttacgcagcaatgcgtcgctccacgaatggaggcggcgagaattcgccgctgttgcagggagaggatgatctgtacgagatgtttttaattgaattgatgtaaaattgagagataatgaaataaattacgattacgaaggatggaaaaatacattttgtatttatttttctgtccttttgtgttatattggaagcaaagatggagggataccaggatgaaggatatctatttaacaaattattctgttaatggaatcaagacattggataaaacggtttcattgtctttttataagaaaacaatcaataaggaaccggatacgcaggaatataatattaagggaatttatggaatgaatgggtctggaaaatcggggatcgtgacttctgtggaaattttgcgcaatcttatcattgatacaggatatttgaataatccggttgcacagaaacatttggatgctattgtcaataagaaagttggggaactttcgatagaagcagagtttatcgcaaagagtggtgcacagttgcttctttttcagtatggaatcaccttgtctaaaaataaggcaggtaaatttacaatatcacacgaatgtttaaaagaaaaaaatgcgacatcaaagaacagttctctggaaatcatttatgaaatttgtgatggtgaaatcatttttatgtatggtttggaggaagaaaatggttttgtggttgaaattagaaataagacgatgaatttgttgaccacgggatctgcatgtgcattgatttatgtaaatatgttatactcaggggacggtaattattccttttatagagaggataaagttgcacgggtaataatgaatgctatcagtgtgctgttttcatttggacataagctgcatgtgtatttagatgagtcagatgatcataaaccatacatgatacaaaataccattctctcttgtgacgatgctgattcgcaaaatgcaaaattgtattcgttgataggtaatatttttgagttacagaatgaaaacataaatgtaatattcagtaaccgaaatatgattgcaaaaacaaggcttgataaatttatagaaacaatcaataaattatatgaatttctccatatttttaaatcggatctgatgggtatagagattgataaaaaagaaaacggcgatttttggatgtgtgatttggttatggtgtatgattcctacaagatttatgcagaatttgaaagtaccggaatcaaaaaactgattaaattatttgtctatgtaagagaaatggttcgtggtggaattgtttttattgatgaatttgattcgaaccttcatgatgtttatttgtgtgcattgttggaatatttgatggaatatggagaaggacagctctgttttacaacacataatgttggaccgatggatgttctgaaacagcacaagaagtcaatagactttttgtcagaggatcatcagatttatccatggaagacaaatggcaactattcaccttcaaaattatacagaaacggtatgatagaaggttctctgtttaatgtagatgcgattgattttatcggagtttttggtacaggtgaggaggatacaaaaagacatgaaacccagaacacaaaaatcaatggaattatataacactctcctgaaccgtggctttccacaggagttttgtgagcagatttcactgaatctgaacacagactggacggcacagaggatgcttggctatttgtcacattacaggaaacttccgatggcggaaatcgtggacgagatgctggcaattctaagtgaccggaaccggattatgcagaagcatgaatgggagaatacaaatgcgaaatggaatgaatttttaaaccagggatttcgaaaagaggattgaaaaataatatgaaagaggttttttatgagttattggaaaaaatttaaaaagaagtatatgggggatcgtgcgttttaccgccattatttattgctggcagtgccaatgatcctgcagaatgccatcacgaatctggtcagctttttggacaacattatggtggggcagctgggaacggaacagatgtccggtgttgcaatcgtaaaccagctgatttttgtgtacaatctggcaatttttggagcagtgtcggcggcaagtatttttggtgcgcagtattttggcaatggggatcacaggggacatatgcattcgtttcgttttaagctttatgcgacgctgcttgtgtcaggacttaccatgttgctgctgcttacgaagggatcggatctgatttccctgtatctgacggatactgcgggaaatggagcaaccgatgtggcacttcaatatggaaagcagtatctggtgattatgctggtgggactggttccgtttgcagtgaaccaggcatatgccaccaatataaaagaaacgggacagacgctcgttccgatgctggcaagttttgtggcggtgggaaccaatgcagtgctggattatctgttgatttttggtgtgggaccatttccggaacttggggtgacaggggcggcacttgccactgtgattgcccggtatgtggaagcggttattgttgtcctctgggcacatagaaaccgggagaagaaccggtatctggaaggggcttatcgcggatttggaatcccggtgagcgaactgaaaacgatactgatcaaagggcttcccctgatgttcaatgaggttttatgggcggcgggcatgaccaccgttacccagtgctattctgtgcgcggacttgatgtggtggcagggctgaatattgccacgacgattaccaatttgtttaacattgtctatatacagttgggagcgtgtatcagtattgttgtgggacagtatttgggagccggagaactggaaaaggcaaaagacgcagacaacaagatgattgttttcagtgtcttctgctgtgtgattatggcagcaatcatgtttctcgtggggggatttttccctgatatttacaatacgacaacggaaattaaggatctggctacaaagtttatcgccgtttctgcgctgattatgccgttttgttcgtttagtcatgcgtcttattttacgcttcgttccggtggaaaaacgatggttacgtttttatttgattcggtgtttacctgggtggttgttgtgccggttgcatttttgctggcacacggcacgggacttggaattgtaagtgtttattttctggtacaggccacggagctgatcaaggtcgtgatcggatactgcatggtacgaagcaacgtctgggtggtaaaaatggtataggtgatcagggatcagaaactcatgctacggcattatttataaacaattgttaaatgtttgaaaaatatttggaaaatggacaacttttgtgaaagaatcggttataataatttcatctgaaaatttaacgaaaaatacataggaagcggatggaattattatcatggaacaggaaaacagagtcagaatggaacgaattgcagcagatccacagtccgggctgtctgcagagcaggtaaaaagaaggtttgcacagggagaaaacaactataaagtagagtcttccacgttgtcggttccggaaattgtgcgttcaaatgtctgcacatattttaatcttgtatttgctgtgattgcggttttgcttgctattgtgggtgcatggtcggatatgctgtttcttccgattattgtggcaaatacctgtattggtattatccaggaggtacactccaaaaaggtgctggataaattatccattctgaatgcaccgcatgcagttgtaatccgtgacggaaagcggcaggagattccggcagatcagctggtgctggatgatattgtggaattttcggcgggaagccagattccggcggatgcgaaagtggtatccggagaactgcaggtgaacgaatccctgatcaccggagagtcggatgaaattgaaaaacgggagggggattccctgctttccggaagttttgtggtatccggaaaggcatgtgcacgtcttgagaaggtcggaaaagattcttatatttcaaagctgactctgcaggcaacgaaaagcaaaaagggagagcagtcagaaatgatccgctccctgaattatctgatcatggtgatgggaattattatcatcccgatcgggattgccctgttcgtgcagtcgtttatttacaatgagggaacgtttcatgacagtatcaccggtatggtggcggctatcatcggaatgattccggagggactgtatctgctgacaagtgtggcacttgcggttagttccgtgcggctggcacagaagaaggtattgatccacgatatgaaatgtattgagacgctggcgagagtcaatgttctttgtgtggataaaacaggcacgatcaccgagccggggatgcatgtctatgatttttctgttctggatggggcagatcagctggaaatttcccagctgctggcagattttgtggcagcgcaggaaaaagacaatgcgacgatggaagcactcaaagcgcatttctcaaacggaagtggtatgcgggcaagggaagtgtattcgttttcttcggaaacgaagtattccggagccgtgatgaacgatgggaaatcttatgtgatcggagcaccggaatttgttctgcgggggcagtttgcccagtatcaggaacagattgccacctacagcagcaaaggctaccgtgtgcttgtatttgcgcaatatgaagggacgcttgaccggaaaccgctgacagagccggtacttccgctttgttttgtgatgcttgccaatccgatccgcaaaggggcaaaggaaacctttacttattttgcggaaaatgatgttgatatcaaggtgatttccggtgacaatccgctgacggtttccgtcattgcggcagaggcggggattgtgggtgcggagcgttttgtcgatgcatcgactctgaaagaaaaagaagattattatcgcgcggtggaagaatatacggtattcggccgtgtgaccccgagccagaagcggatgctggtacaggcactgaaagaacataaaaaaacggttgccatgaccggagatggtgtaaatgatgtgctggcacttaaagatgcagactgcagcgtggcgatggcctccggcagcgaagccgcttctaatgtggcacagctggtacttttagattccgatttttccagaatgccatcggtggtcgcagagggacgccgtgtggtaaataacattgagcggaccgccgcattgtatattgtaaaaaacattttctccatgctgcttgccattttctccgtgattctgatgctggattatccactggaaccatcacaggtatcgctgatcagtatgtttacgattggtattccgtcgtttgttctggcactggagccgaataaggatctgatccgcggacatttcctgacaaacgtacttgtgcgggcacttccggcaggactgacggattttatcgtagtaagtggtctggtgattttctgccgggaatttcaggtagatctggattgtctgtctacatcatgtaccattctggttgcaatcgttggttttatgattctgcaccgcattgcaagaccgatgaataccggacatattgtaatgctggtcggcgtgattgcaggatggattctttgcatgctgtttggcagaagttttttcggaattacggaaatttccaaacagtgtgaaatgctgatggtaatttttgcaattattacggaaccggttcttcggtatctgagcctgattgttgagtggatttctgcgagatgccgcatgatccatgcccgtttttcgagggcgtaaaagtggggctggttcttgcatgcatataaggaatcgtatataataaaagacatactagtagaaaagcaggtgtggatgtgcagaagagaatcaggcagatagccgcaggaaaattcgaatcggatcagccttcgctttctatttcggacgaggaactgtttcttacggttacagaaggacaggaatataccggggaatttgaaattaccagtgaaaaccatattccggtgcggggcattgtctactccacccacccaaggatggagtgcctgactccccagtttgaaggcgaaaatatacggattcggtatcagtttcatagtaagggtctcgttgaggggcaggaggaaaagggtgcgtttgtgattctttgcaatcagagtgtacacagcctttctttttgtgtatccatatcccgtttatatgcgcagactgccacaggtgcgattcgcagtctttcggattttacggcacttgcaaaggaaagctggcaggaagcatatcagctcttttatcacaagagttttcccaatattctaaaagcaaaagagacaaaagaaaagatgtactatcaggggattcttgcggcaaaaccatcgtcgcagaatctggaagaatttttggtggcagccggcagaaaagaacagatccattttacaatttctgagacagactgccggtttgatgcgcttaccgaaagccagcagcagaagatcgaaatcaaaaagagcgaatggggatatttggaacttgccatcacctccgatgccgcgtttgtacagccggcacagacgcagattacttcggaggattttctggggagtacgtttgtcctgaaatacatcgtggactatgaccggatgcatgccggaaacaattatgccaaaattactttttcctcggtatatgagacaaaggttctggagatttatgcgcacaaaggggaaaaacaaaagtccaaagaacaaaaagaacatgccaaaatcagggaatgtcagtccgggctggtagaactgtatgaggcattccgcctgaaaaaaattgtgacaggtgtgtgggcaaatgagtcggtagaacgtttaaaccagctgcatgccatgcttccggatcaggtgatgtatccgctgatgaaagcacaggcactggtgatcaatcaccagaaacaggaagcggagtggattcttgaggaatttaaacgggaatggcccgatcaccatacaccggagtgggggtattatctttatattatgacacttctggaacgggaaccggcatatgtggaccgcatgacgcatgagattgagatgatttttcatgaaaatccggattctgctttgttattctgggttctttcgtttctggaagaggaatattacaacaacagtgcgcacaaactgcgtgcaattgcgcactgggtgatgagcggctgtgtttccccgtacctgtatctggaggcatacgatctgatcagccatgacccgtatctgctcacaaaactgggaagatttgaagtgcggattctgcgctgggcaatccgtcatcaagttctgacgaaggaactggcagcacagatttttgaagtggtggaaatgaatcagggatttcatccggttcattttgaactgatgcaggcagcttacgggacagaggaaaaaccggaatatgtgggacagatctgcagttacctgataagaacccagcagtttgatacaaaatttcaccactggtatgaaaagggaatcgggcttgaacttcggattaccggattatacgaggcttatctgatgtcactggatgaacgggagattgcatcggttccaaaaattatccggatgtactttcagtatgacagtaatcttccctatcggaagatggcaattctttacaacaatatcattgcgtcaaaggaaagcgaaccggaaatttatgaacagtatcgccgggtgatgagccgttttgccatggaacagatcgagcaggaacatgtggacgataatctggcggtggtttatgaggacatgctcgaactggggctggtgaatgaagaacttgcaaaatgtctttccaatattctgtttgcacataagctggtaattatgcagccgcatatggtccgcgcgattgtataccagaagcagatgaaagatccgcagatcgttccgattgtaaacggatgtgcttacgtgtcccttttctgcagggaatatgccattttgtttgaagatgggaaaggccaaagatatatccacagtgtcccgtaccggctggattccctgatggatgccggatcgtatctggagaaatgtacggcactggcaccggaggaacttccgtatattgtttcccattttggggaaaaaccggatcatcatatgtttgatgccaaagaggaaaaatttttccggagagtgctgtttgcacaggagctggatacggaataccagtcgtatttttccagggagattgtgcgttattatcagaaaaaagagcaaaaacccctggtggaacaatatctggaacaggcagattatgagcagatgccgcaggcggtgcgtcagtatatgatggaatcccttgcagactggcggatgtatgaccggttgtatgaacagatgcaggaatatgggctggatcagatcggatcatcggcaaaggttgcagttgccacctatctgctggatgcgatggaagagagggagcaggacgaggaactgctgcttttgtgtacaagtgcgtttttaaacaaaaaatacaatgacaggattctgcagtatctgagtgatttttattccggaccggttgagaccatgcttcgtttatggagagcggcacaggattttgaacttcggacaagagatctggaagaacggattcttgagcagatgctgtatacggatatggatcttatgcaggcactggaggtatttgcgcattattatgaaagcggtgggcaggaactgattgttcttgcggtcattacggtatttgcgcagaattattttgtaaaagaagccgcgctgccaaaacaaatccttgccataatacggagacggtatcagagcggaaagaaactaaatgatgcctgtaaacttgccctgctcaaatcgttttccgggatgtcctctctgcaggaggcacagtatgaagccgcagatgtgctgctggcagagttcaccggaagaaatatgaatttttcattttataaaagactggaccggcggctggtacagaaatatcatttgtatgacaaaatttatgtggaacaccggacaaatcaaaagaaacatgtcgtgctgcactacagccgggatgaggacggggagcagtttcacgaagtggatatgccgaatgtctatgccggtatttttgtggaaacatttgtggtatttttcggggaggagatccagtattacatcaccgaagaatataaaaataaggtcgtctcgacggaaagcaatcgtctgacatgtaacgatatctatgcacagaaagatgaaagcaggtacaatctgatcaaccagatgctgatttcagagactttatccgatgaagtttccatgtttcagacgatgaaacagtacgcaggatatgatgaggtgacgaaaaaagtatttaagcttttgtaagcaggatgggagaagagatggaagccaatacctgttatcttggcatcgaactgaacgactcgtatgccatggtaagttatatgcaaccgaatatggaagaaccggagacggtcagcacgattgccggcagtgaaaattaccggattcccacgctgcttgcccgacgcaaaaatgtcggcatgtggtattatggggaagatgccggaaggatggcaaagaccagtgaggtgatttgtgtggattcccttcttcgccgtgccgctgcatcggaagtgattaccattgcaaaagagagttatgatgcagtagatctgctggcactgtttattaaaaaagtgattgaacttccgcagaaactgggaaatacttcgcatgtgaccggaattgtcctgacggtggatcatctgacgaaagagttgatcggcattttccggcatgtggcagaacttttaggattgtcgcaggaaacatttgcggtgatcgatgacaaagagagtttctatgcgtttgccatgaaccaggagaaatctttgtggatgcacgatgtgtttttgttttcctgcgggaagaatgccgtcagttcctatgacctttcgagggatatgcatacgaagccgcagatgatcacgattcacgcaaccggggcacaggaactgggagaggagaaagatgaggcgtttgcaaggcttctgactaactgttttgcaaaccgttcggtatcttcggtttatctggtcggggacgggtttgacggagaatggatgaaacagtcactggcagttctctgccggggacggcgcgcgtttctgggacagaatcttttttccaaaggggcatgctatatggcccgcatccgtgaaatgggagaaaactggccattcatttacatgggcgaaaacgagatgaaatttaatctgagtttaagtgtcgtggaaaaagaaaaaaagaaggttttaaatcttgtcagtgccgggaaaaactgggagataaaaaatacatgtgaggtgatcctaagcggcacgccgcaggtggaatttttaaagcagcttccaagcagcagtactccccagatacagacggtggaacttgaggatcttccggttcgtccggaccgcacgacaagactccggattacggccagtccggtggcaaatgataagattgaagtggaaatccgggatctgggatttggtgaatttttcccggctaccggccgggcatggaaaagtatcataatgatgggataaacgtatgggtgaattattactttgtcatgaaacaattgcggctctgccctattatatagaggaaaccgggataaacatatattccatggaagaactcagctattatatttccggaaatgtgtatcttttagatcattccttcatgtgcgagagtttatgtacatgggtggaaaaacagatgcatcgtgtcgaactcgcacaaaaactcagggagaatatccgcacagaaggaaaattgtccgattttgtttttgccgtattgcaggatacggcatactgtaccatgaaagaaatgcaggagatcgtttttgcggtccggcaaatggaacagaagtcggattttgaatgtgacaagatccgggcagaccagctgatggagaaggaaaaatatctggcagctatttaccggtataaacatctgttagacgaagcagatacgaaggaaaccggtgaggttctgcggggaaatatctggcataacctcggaacggcgtatgcacgtctctttttgtttgaagaggcagggcgctgctttgagaaggcatatgcattgaataaacaaaaggaatctctccgggagtgcctgatgtgctgccgctgccggcatgatgaggaagcgtttgcggaaattgcaaaaaaatatcaggtggaggagagaaagcagcaggaaatcagaaatgaaatttccctcgcatgtaagagcgaaaaactcgaacagtttgaatcccatctggaagaattagcgcagcggaccgggggtgtccaaaaggcgaaggcaaggaaagaagcaatggatgtgattgttcagtggaagaaagagtatcgaaggagctgcaaggtataacatatgattttttcaaatttatttcatagaaaaaagaacaaagaaagtgagacaggaagtttctcacaatatgatcagagcgagtatgcaaagcttgagacaaagaacattgtaaaagaactgaatctgtcggacgcggcgcaggcaaagaaatatgtagtggatttgtgtaagcagatgattcaggcgtctaaggatattgaagatagcaaatcggaatatcagctggtgacaaattatctgacagatattcagattctcgaagacctgacggacgcagagcgtaaaccgattcttgagtgcgccacacaggtcgcaaagctggaaaagcaaagaaccgatttcctgaaaaccaaacgccggctgacagatacgcagtttgcgcagatgcaggaggaagaagagaatcttccgggagtgatccgccggctgaaagccaatgaggcagatctggatgccatcaagagaaatatggcatatctggaaggaaaaaaactggaatggtccatgcagcggtcagattccgcaaaggtacagaaagtaacccgtaccgcagcatgctatctgttagctgtatttattacgttgtttgcttttgtgggaatactttcctggtatctgaacagggatctgcagctagttttcaccattatgggatttgcagctgttggagcgggcgcgtttattttgatccgttatcaggattccacaagagagatccgtcaggcggatgtcaaccgcaatcaggcgattactttggagaaccgggtaaagatccgctatgtcaatacgaaaaacgcggtggatttcatctgtgaaaaatatcatgtccgcaatgcgaaagaactggaatttttatatggacagtatcaggaggaagcgcgggaaaaggaaacattccgtaaaaccagtgatgatctggattattatacgcaaaatcttctgcagtatctgacacggctgcggatgtatgatacccgtgtatggctgacacatgcaaatgcgttggtcgacagccgggagatggtagagctgaagcatgaactgctgacaaggcggcagaaactgcgggcacgtatggagtacagtgtgggaagtatccatgagatgaagggtgaggctctcaaaaatatgagcaagctcggaaacaatgcttatcagctggagcagatcatccgcaagattgaagcgatgaatccggtatttaagtaaaaataatagtgatttatagcgttttcttttgagatagccgcccggtgtgaaaggggcggctatctcctgtcttatcgtgtagtgttttgcatacagtcaaaattgggattgaaagcatagtagtttttgctgtccagttcttcctgcagcagacgaagagcctcgccaaaacgctggaaatgcacaatttcacgctcgcgcaaaaagcggattggatcagcaacttcctgatcttttgccagacgcagtatattgtcatacgtttttcttgctttttgttctgctgccatatcttccaccagatcagcaatggcatcaccgcttgactgaaattcggtagcggaaaatggaactccacccgcagcctgcggccagacacctgcggtgtgatcaatataatatggtgcaaatccggaagcttccagttctttggcggaaagtccgcgcgtcagctggcgaacaatcgcaccaatcatttcgaggtgagcaagttcctcggttccgatgtcggtaagtacaccggcaatccgcggatttgcaaaagaaaaccgctgggccagatagcgcatggaagctcccatttcgccatcgggaccaccgtactgacttataataaaagatgccatcttagcatttggtgttgaaatggaaatcggatattgcagtcttttttcataattccacatagcttatttcactccttcccatggcattggaccgtcattccagtcccagtcctccagcggctggctgccaaatgcggacaacggttcgaaacgttcctcgtatgtctttttagctgaattgtataattcgttgcactgattgtaataagagagtgcctgtgcgtcatccggatgggtgtccagataaagaagcatatcataggcacaaaagcccagtgccataacccagcggtacaattccgaccggttcattggctgagaagatggtcttgtcatcgccgccgccctccctgcatcatattcatattgcattttccggtaaatggtttatccagttccggaaaaattgtgcctgcggcaagcccgcgcatgggatcgtaggttttgccgaatgtctgccagggaacgtagcacatgccaggtacctgatggctgccattgcctgtttccggcatagtattaatagttgcattcatggatttctttttcctttctgatcagcatatactgtatgatatgtttcgtttgcgttatgtgtgtatttgttatataataaaacacatgacagaataaggagagaaacgcaatgagtaaagtaagaacaagatttgcaccaagtccgacaggaagaatgcatgtgggaaatcttcgtacggcattgtatgcatacctcgtagcaaagcatgagggcggagatttcatcttaagaatagaagataccgatcaggagcgttatgtggaaggtgcggtagatattatttaccgcaccctgcagaaaacaggcctgatccatgacgagggaccggacaaggatggcggctgtggaccatatgtacagagtgagcgtcaggcacagggcatttatttaaaatatgccaaagagctgatcgataaaggcgaggcctattattgtttctgtgacaaggaacgcttagagggactcaaaaaagtagttgcaggaaaagaaattcatgtatatgacaagcactgtctgcatctttccaaggaagaagtagaagaaaaacttgccgcaggcgtaccgtatgtcatccgccagaataacccgacggagggaacgacaacgttcgaggatgagatttacggggatattaccgttgacaatgcggagctggacgatatgattctgatcaagtccgatggatatccgacttacaattttgcaaatgtggtagacgatcatctgatgggaattacccatgttgtccgtggaaacgagtatctttcctcttccccgaagtacaatcgtctgtatgaggcatttggctgggaagtaccggtatatatccattgtccgctgattacggatgaaaatcatcagaagctgtcaaaacgatgcggacattcttcgtttgaagatctggtagagcagggatttctgacagaggcgatcgtgaactttgttgcattgcttggatggagcccggcagataaccaggagatcatgacactcgaagaactggtagaaaagtttgattaccatcatatgaacaaatcaccggcagtctttgactataccaagttaaaatggatgaacggggaatacatcaaaaaaatggactttgacaagttctacgagatggcacttccgtatatcaaagaagtgatcaccaaagattatgatctgaagaagattgcacatatggtacagacccgtatcgagatcttcccggatatcagggatcacattgatttctttgaggaacttccggaatatgatgtggcaatgtacacgcacaagaaaatgaagacaaatgcacagacttctcttgaagtgctgcaggagatccttccggtcttagaggctcaggaagattacagcaacgatgcattgtatcagacacttcttaagtatgtagagcagaaaggctgcaagaacggatatgttatgtggccgatccgtacggcagtatccggcaagcagatgacaccgggcggtgccaccgagcttatggaggttcttggaaaagaagagtctcttgcccgtatccgtaaaggaatcgagctcctttctcaggcacagtagaacattctcacgggagaacgaatgaactataataaatcccagcagcaggccatccgccataaggatggcccgatgcttgttctggcaggtcccggttccgggaaaactgcggtaattacccaaagaacgaaacagttaattgaatatgagaacatagatccgtccaatattcttgtgattacatttacgcgagcggcggcacaggagatgaagcagcgttttcttgcattgacaggagaagagagaacgaaagtgaccttcggtacgttccacgccatatttttcatggtgctgaagctggcgtatcattttgattccggaaatattatatcggaggagcagcgatatcagtttatgcgggagattctgtcttatcatcatctggaataccgggatgaaggggaatttatcggggatgttttaacggagatcagccgtgtgaaaaatgagcagattccgctggaacatttttattcttccagctgtggggaggaggttttccggaagatttaccgggaatatgatgagcggctcaaaagaaaccgcctgattgattttgatgatatgctgacatacacatatgagttgttttcccagcggaaggatattctttcggcatggcagaaaaagtaccgttatattctgatcgacgaatttcaggatatcaatctgatccagtggaagatcatgtgtatgcttgccgcaccggaaaataatctctttgtagtgggagatgatgaccagtccatctatcggttccgcggttcgaagccggaaattatgctgggatttcaaaagatatacccgcaggcaaagattgtgaatcttgaagtaaattaccggtgtgagccgccgattgtggaggcagctatgcgcctgatcgcacacaatgaagaacgttttccgaaaaagatccgtgccggaaaatccgggaaacagaaggtgcgttttcagtactttgaggactgctataaagagaatgcatttttggcagaagatatccggcagactgtgcaaaatggggttccgctttcggaaatcgcagtactgtttcggacaaacatgcagccgcgtgccctgatggaatatatggtttctgccaatctggcatttcagacgaaagaccggattccggatatctatgagcactggattgcccgtgattttttcacttatatccgcatcgcacagggaagtgacagcagggccgatttcctttctattatgaaccggccgaagcggtatatcggcagggacagcctgcccgatgaaacggtatgttttgatgagtggatgaaattatatgaggagcagccgtggatcgcggagcggatcgaaaagctgtggtatgatctgaaacatttgtcccgtctgagcccttatgcggcaatcaactatatccggcggggaatcgggtacgatgattatctggcagagtatgccgaataccggaatgcgaataaagaagatttttatgaagtggcagatgaaatccttgcgagtgccaaagggtaccgtacatttgaggaatggtttgcacatatagaagaataccggcaggagttaaagagactggcacaggaaaagcgcaggaatcagaatgctgtgacatttgcaacactgcacagcgccaaggggctggaatttacaaaagtgtatctgattgacgtcaacgagggtgtaatgccttataagaaagcagtattaaagcaggatgtcgaggaagaacggcgtttgttttatgtgggaatgaccagagcaaaggaatccctgaccatctgttcggtaaaaaaaatgcgtggtaaagaggtggaactgtcgcgttttatcaaagaagccggtaaagagccgtaaaaaacctgcatcgggtattcgatgcaggtttttataaaagttattcctcgtcttcgagtgcgttgaagtagtcatcatcgagcatttcatcgaagcggtcagcagcggcttcgtactcgtcgtcatccgtgatgctgtcgatctgtggaagaccttcttcatcctctgcatagcggtagagataaacggtgccttcgtccggatcagagccgtctggattgagcggcatcagtgcaatgtagtcctgttcatttacgtcaaaaatggtaaggattttgcattctacttcaccttcatccagctcaagtgttacacggatatcttcaatctcatccggggtaacgggtgttgctttttctttatcttccataagatacctcttttcttaatcgttttttgtgtcttttatcattataagcgaggagtaaggagcttgtcaattcgaaaaagtgatatacaaagttttttaaaaagggtataatgaaaaacatgaaaatacgagatacgaaaaaacgaacagagaataaaaggatcagagaaggagattacgcaaaaccgggagtgacgattcagggagaatggaccacttttacgtttgatgcggaaaaagaggacagctgttttgtggtacttaaggatatacagaccgaaaaagaagaaaagatagctgttccggcagaatactgcatgggatcggtgcgctctatcgcagtggcagatctgcatctcgaacatctgatttacgattttaagatcaatggaaaaaaggtaatggatccgtgcgcacacgccatcatggggcggcaggtctggaatgacagttcacgcagccggcagcagtatgaggtgcatggggcatttgatgtgcaggagtttgactggggggaggatgtatgtccggaaataccgagagaacagatgattatgtacaagctgcatgtgcgtggttttacgatggattccggtaccagaagtgttccggggacatttcgtgcgcttatgaaccggattccttatctgaagaaactcggtgtgacaacagttgaacttatgccggtgtatgagtttgaggaaattgaactgccaaagcagcagaaacttccggaatatatccgttggaaagaaaaacagacggatcagatccgcccggcagaaaaaataaaaaaggttccgcgcaaagtgaattactggggatatgagcccggaaattattttgcggtgaaggcatcgtatgctgccgatccgctgcatgcttcccgggaattcagaatgctgatccaccgtctgcacgaaaacggcatggaatgtgtgatggagatgtattttccggagaaagtgaatcataatctgattttagaagcacttcgttactgggtgcgggaataccatgtggacggaatccatctgcttggggaacatctgcccattacggcgattgtgcaggatggcatgctcagccgtaccaagattttttatgtgaattttgaggaaaaagcatgtgcggcaagccggaaatatccgaatctgtatatttacaaagaggagtatcagtatccggtacggcaggttttaaatcatatcaatggaaatatgcgtgattttgccgatcagcagagaaaacagggggcttttttaggctacatcaattatatagcaagcaacaacgggtttacgcttgcagatctgtttatgtacaacgataaacacaatgaggaaaatggagagcagaatctcgatgggagttcctggaatttcagcaataattacggcgtggagggaccgaccagaaagcgttatatcaatgcgctgcggaaattaaactggagaaatgcggttcttatgcttatgctggcgcagggggttcctctgttgtggagcggtgatgagatgggaaattcccagaacggaaataataatgcatactgtcaggataatcccaccggctgggtgaactggaagaatgagaagtctcatcgcagacagatcgaatttctgcagcaggtaattgcgtttcgaaaagaacataccgtgctttcaaatccgatgccattccagttttcggattataaatcgctggggtatccggatctttcctatcacgggacaagtgcgtggatgttagaaccgacaccggatcatctatgcctgggaatgctttattgtggggcttatgcccaaaacgaaaaagagccggatgtctatgtcgcctataattttcttgccgcggcaacggaactggctttgcctaaaccgcgaaaagggaaagaatgggttgtctgtattgacagcggagaagaggatgctgcgtttttggacgcaccaaagcccgtaagcggaggaaaaatcattctccggccacagaccatctgtgtgctggagagcagggagatgaaaaaacatgggtaatgcatggaaacatttttgcacaattacacatcacaaaaatctggtgcttgtcggttgctttaagatcggactatacaggcaggggttgctgcatgatctttcaaaatattctccgacggaatttctggtcggttgcaaatattatcagggaaccatgagtccgaacaatgcagagcggaaggaaaaggggtattccctggcgtggctgcatcacaaaggacgcaataaacaccatctcgagtactggattgattatgatatttcaaaagaaccggggaaagaacattcggggatggcaggaatgaaaatgccggtgtgctacgtggcggaaatgtttgttgacaggatcagtgcatccaaaaactaccagaaagacaaatacacggaccggagtgcactcgattactatatgcacggcagatcgcattatctgatccatccggataccgaggcactgatccactatcttttactgatgctggcagtgcggggggagaaggaaacatttgcatttgtaaagaatgaggtactgaaaggaaacgttccttatgagagggaaagcctgatccggcgcatacaggaactggcaccggaagaaaaaatataaaagggaaaagcacagaatgccttctgctgacatagaatattagaaagctgttggaaaaggtgctgtgtgaaaacatttttggttcccctgacaccggaagaggaaacagactgtctgtgcagattaaaaaatggcgagcaaggggcaaaggaagaactggtgttgcacaacatgcgcctggtagcccatgtcgcaaaaaaatatgtcagttcggaagaagaacaggaggatctgatttccatcggtacgatcgggctgatgaaagcagtagacagtttccggccggaatacggaaataaatttgcaacgtatgccatccggtgtgtggacaatgaattgctgatgcatctgcgatcaaagaaaaaacagcgcaaagaagtttctatgtttgaaccgattggtacagacaaagaaggaaaccagattcagcttgtcgatgtgctggagtttcatgataaaaatgtagcagatgaagtgacaaaaagggagcagatgaaaaaaatctgtacctttatgaatgatgtgttaagcgagagagaagcatttatcattcggcgaagatatggaatcggaggaaatcaggaactgacccagagagaaatcgcgcgggcacttggaatttcccgttcctatgtttccaggattgaaaagagagcactggaaaaacttaaaaaagtgataagcgaataaagtcgttgcaaaaagatgcattttatgataaggtaaatgcatcttttttcatgcatgtgtctgtgcaaaattcccatttgttggaatgaggtgaatatgtatagccaaatcaggacatccatgctggatggaatctgcgcaatgccggtacaggtagaggtggatatcagcatgggaatgccggtgtttgatatggtaggatatctttctccggaggtgcgggaggcgaaggaacgagtgcgtacggcgcttcacaattgcggaattcttctgcctgcaaagcggattaccgtaaatctttctccggcaaatataaggaaaaccggaaccggatttgacctgccgattgcggttgcactactggttgccatggggctggtaaaaccggagaagtgcgcggacacgattttttccggggagttgaatttaagtggacagttactgccggtccggggaattctgccgatggtttcggatggagtaaaggaaggaattcataaatttgttgttccggcggataatcttatggaaagccgtctggtgcagggggcggatgtctgcggattttctgcattggaatcggtgatcggctatctgcaggatggcggttataaagagccggcatatgcaggccggcggcagaacagatcccatggggtgccggatttttccgaagtaaacgggcagcagtttttgaaacgggcagcggaaatcgcagcgtccggaatgcacaatatgcttatggtcgggccgccgggagccggaaaaaccatgatctccgagcggatggctacaatcctgccgccacttacaaaaaaagagcagctggaggtttcaaaaatatacagtgtctgcggtctgctggcagactcccggacactgttgcaggaacggccgtttcgcagtccgcatcatacggtcagcatggcagggcttgccggcggtggacgaagtatccggccgggagagatttcactggcacatcatggtgtgctttttctggatgaactcccggaattttccaaatcaacgatggaagtgctgcgtcagccgttggaggaacatcagattcatttgacgcgcgcggtcggcagtgtgacctatccatcggattttttacttctggcatccatgaatccatgcaattgcggatattatccggaccggaatcggtgcagatgcacacaggcatccctgcagcggtattttgaccggatttcccagccgctcattgaccgcatggatctttgtgtggaagcgccgatggttacgtatgaagaactgacgggaaacggcaataatgagagttcaaagaccatccgggaccgggtgtgtgagtgtcaggaacgccagatttttcgattcaaagacgaaaatttttctcacaacagtggaattccggccgcaaaattaaaccagttctgccggctgggagaaaaggagcagcggtatatggaaaaaatgtttcataaactgtcacttactgcgcgcacctaccataaaatcctccgggtggcacgaacaattgccgatacacaaaaggcggaaaacatccgtgtctgtgatctgacagaagctgtgtgttaccggagtatcggggataaattctggggaggtatggaagaatgagcatgtatgcgtactggcttgcaaataccggactgaccgtacataaactgacggggcttatgacagaagggatcggtgcggaagaactgtatgccttgcaggagtcccaaatgaaaaaaatccgggttctggatgaaaaggatgtggaaaaaatcacacaatccagacggcactgggatgtacaggagcactggggaaaactgcagggggaaggaatcggttttgtctgcgtggaagaagcacggtatccgcaaaagctccgccggatttctgcaacaccttatgcgctgtattatattggcaggctgccggaagaaacacgaaagagtgtggcaattgtcggggcgcggacaagaagtgcctatggaagccagattacggggaaactggcgagggcacttgcgcagaaccggatggatatcatcagcggcatggcgatggggattgatgctgatgcgcatagcggagcactggaagaaaacggggatacctatgcggtactgggctgtggcgtggatgtgtgttatccgaaaagaaaccggtatttatatgaaaaaatgaaggatcggggaggtattttgtcggaatatccgccgggcacaccgccgctgccgggatattttccgcaaagaaaccgtatcatagccggacttgcggattacgtgattgtgatggaggcaagaaaaaagagcggatcgctgattactgcggactatgccatggaacagggaaaggaagtgtatgcccttcccgggagagttacggatgccctgagcgaaggaaccaaccatctgatccagcagggcgccggcatttttgtaagtgtggaagatttcctgcaggaactgcaattacagccccaaaatataacgacacaaatagactttagaaaaaatcttcttgaaaaagacgaatcgttggtgtatgctttattagatttttatccggtgggtcttggaaccctgatcgaaaaaagtccctatggtctggtagaaattctgccggttttagagaggctggaacagaaagggttcattcaggagaccattccgaattattatataaaaacaatttagatgatataaggagcaccaaatggcaaagtatctggtaatcgtggagtcaccggcaaaggtgaagacgattaaaaaatttctgggaaaaaattatgaggtcatggcaagtaacgggcatgtgagagatcttccgaagagtcagctcggattttctccggaaaatgattttgaaccgaaatatattacgattcgtggaaagggagagattcttgcaaagctgagaaaagaagtaaagaaagcggataaaatttatctcgcaactgacccggaccgtgaaggagaggcaatttcctggcatttaaccaaagcattgaagctggaggacaaagatgtcagcagaatcagttttaacgaaattacaaaaacagcggtaaaagcatccttaaagacaccgcgtgagattgatatggatctggttgatgcacagcaggcgagacgtatgctggaccgtatggttggttaccggatcagcccgttgttatgggcaaaagtaaaaagagggctgagtgccggtcgtgtacaatccgttgctttacggattgtgtgtgaccgtgaggaagaaattgatgcatttattccggaggagtactggtctttagaggcaagcctcctgccggaaggtgagaaaaaaccgattacagcaaagctgctggacaaaggcggcgaaaagtttgagatttcttccgaggaacagatgaatcaggtgcttgcggaattaaaaggcaaagaatttaaagtctgcgatatgaaaaagggagagcgcacaaaaaaagcgccgcttccgtttacaaccagtactttgcagcaggaagcttccaaagcgctgaatttcccgatctcgaagacgatgcggattgcacagcagctgtatgaaggtgtggatatcaaaggacagggaacggtcggtatcatcacctatctgcgtacggattccgttcgtatttcggaagaggcggatgaagcagcgcgtgcctttatttccgaaagctacggagaggaatatctgtctgacggagaaggaagcaagaagagcaatgcaaagattcaggatgcgcacgaagcgatccgtccgaccgatattaaccgtattccgtccgagattaaagagtcgttaagccgggatcagttccgtttataccagctgatctggaaacgctttgccgcaagccgtatggcaaacgcaaagtatgagacaacaaccgttaacattgcagcgggagattatacattccgcgtttctacttccaaagtagcttttgacggatttatgctggcctatacggaagcagatgatgaaaagcaggaaaaacaggtacttttaaaatcaattgataaagatacaaaattaaaacttgaagaattcgatccgaaacagcattttacacagccaccggcacattatacggaagcttcgctggtaaaaacactcgaagaactcggaatcggacgcccaagcacctattctccgaccatcacaacgatcattgccagacgttatatcacaaaggaaaataagaacctttatgtgacagagatcggttccgttgtcaattccattatgaaggaatctttcccgactattgtagacgaacattttactgcaaatatggaatctcttttagacagtgttgcggaaggacatttaaactggaaaacggttgttgcgaatttttatccggatctggaagaggctgtggaggccgcggaaaaagatctcgaaaagattaccattgaagatgaagtgacggatgaaatctgtgaagtgtgtggccgcaatatggtaatcaagtatggaccgcatggaaagtttctggcatgtccgggattcccggagtgccggaataccaagccatattatgaaaagattggtgtcgcatgtccgaaatgcggaaaagacgtggtcatcaaaatgacacgcaagggcagaagatactatggatgcattgattatccggaatgtgatttcatgagctggggacgcccggtagaaaagaaatgtccgcgctgtggaggctatatggtggaaaagggaaacaagcttgcatgtgcggatgaacattgcggttacacggaagcaaaagaaaaagaaaccgaatagtcgtaaatttttcgaaaaatattgaattgtctgataaatagtgctacactcatggtatctgtgatagagacaggaggaaaaacatgagtgttcaacttctagacaagacaagaaaaataaataaactgcttcataacaataattcgtccaaggtggtatttaacgatatctgtgaagtcctgacgggaattcttgattccaacatccttgtaataagcaagaagggaaaggttttaggttccagtgtatgcaaaggggttgaggaactgcaggaactgatcgtggacgaagtcggcggatatattgatgcagaactcaatgagcgtcttctgggaatcctttccacaaaagagaacgtaaatctggaaacgctcggattcggagatgaatccaaaaagtaccgggccatcattaccccgattgatattgccggggagcggctgggaaccttatttgaataccggtgcgaaacggaatatgacattgatgacattattctgacagagtacggaacaacggtggtagggctggaaatgatgcgttctgtaaacgaagagagcgcagaggaagcaagaaagattgcaatcgtaaaatctgcgatcagcacactttctttctcggaacttgaggcaatcacccacatctttgatgaactggatggcaatgagggaattcttgttgcaagcagaattgcggatcgcgtgggaattacccgttccgtgattgtaaatgcacttcgtaagtttgagagtgcgggcgtgatcgaatcgcgttcttccggcatgaaaggaacttacataaaggttgtcaatgacgtggttttcgatgaacttgcagaactgaaaagaaaaaatgcaaaataaaggatggaaccgagcggacagcaaaaggacttgtatgtaaatataagtccttttttgtcattttatgtaaaaaactacttgtattttgcttgatttatactataattagtatgatacgataatagggaatactagataaggaggcacaaaattgctgagtacagatgctttcaattatgtgaatgttctggataaagctgccgatgcgagctggagcagggagaacattctgactaacaatattgcaaatgtaaacactccgggatataagagaaaagacttaaattttgaaaatacattaaaaacagaactgggccgctgcaagcatgagtccctggattcgaaaatgaaagacgtggatctttccagactgaatccatcggtttatgtggacagttccaattactcctatcggctggatggaagtaatgtagatattgatacagaagaagtggagctggcatccgaacagatccgctatcagggaatcacagccggaattaacggacagtttgaccgtatgcgttccgtgattaagtaagggggaaagataaatggctttatttcaggcgtttaatatcagcgcgtcaggcatgaccgcagaacggtttcgtaccgatatcattgcggagaacattgcaaatgtaaatacaacatcaacagagagcggcggtccgtaccgacgcaaaattgtaaattttgcagaacggaaagttaccccgttttcccaatattacgcaactgcatcgcagaatccggcaatcggaaacggtgtaaaagtaacttccgtaaaggaagatacggaaacagatttcgtgaaagaatatgatccttccaatccggatgcggatgcggacggatatgtatcctatccaaatgtaaacacggtcacggaaatgaccaatctgatcgattctacccgtgcatatgaagcaaatgcgactgcatttgatgccacaaagagtatggcaaccacgggactttccataggaaaacaataataaaaagtaagttatacgagagaggacaaaagcatggatatcacacaattgtctggagtttcttctgactatctgaatacattcgcaaaaaaagaggcacttgttccgggagacgatgacagtttcagcgcggtgctttcaacagcgatgaaatcagtagatgaaaccaatgatctgcaaaataccgcggagtcggaagaagtacggttcgcacttggggaagccgaaaatccacatgatctgctgattgcagagacgaaagcaaatgtagcactgcagtatacggttgcagtgcgggataaactgattgacggatacaaagagattatgcagatgtcaatctagtaagtgaggaacgaaaacatgccagaacagttacagaaaatccttgaccgtgtggttgagtggtggaaaaaattttccaataaacaaagaatgctgctgatcagccttaccgcagtggtgatccttgcgctggtgatactgggagttgttgtatcaagaccgagttatacaacactgattgactgccagaacgcaaaagaagccagtcaggtaaaagatctgttagacggcgaaggtgatattgattataaggtaacggataccacacattttgaagtaaacaaaaaagatgagaacaaggcaaattggcttttgggatccaataatattgatacaacgggatttgacctgtcagatccgaacatcaaggattatatcgacggaagtttttctaccacggaggcagataaacagaaacttgccaaaagctatatggaagataaactggagaatgtgcttgctgcgaatgacctgattgattccgcaaaagttacactggatattccggatgatgacggtacactgatctcacggatgcaggaaagttctgccagcgtttcgcttgccctgaatggttctatggattcggatcaggcgtattcggtggcgcgccttgtggcaaccgcccttggaaatgattcgacagacaagattaccattctggatcagaagacatccaaaatcttgttttcgggagcagaccaggatgatgatgccacggttgtttccgacagtctggacatcaaagaccgcattaagaattccgtggtcaatggtatcaaggatgtaatggtcaagtccggtatgtattcggacgtgcaggttgcgccgaaccttgatattgatatgtccaaggtggaaaaggcggttcacaattattcacacaatgatggacaggatcagggagaactgacagaaagctctgagtataattcggaggcaaaaggtggacaggctgcaactccgggaacggattccaatgatgatacgccaacctatgtgacaccggatggcgagattacagaatcttccgtgtcggatgtggataaaaaatattcgccgaatgaggaaattataaaaactatttcaaacggtggagcgatcaactatgataacagttccattgccgtgactgccacacgctgggttgtttatgatgaggacgaattgaaagattccgggcagctgaaagggacaacgtttgaaaagtttaagagcgcacacagtgatccggtacaggtggatgcaacgcaggatgaaattgaccttatcgcaaaagctaccggaattcagtctagtgcaattaaactggtctgttatgaaagaccgcagtttgtggaatcccagaagaagggattcggactcaccgacattttacagattctgcttgcggtgctgatttttgcgttgctggggtatgttgtattccgcagtaccagaaaacagaaagtggaagagccggagccggaactgtctgtcgatgccctgctggcggctacttcagataacgacgatgaaaatctggaagatatcgggtattcggaaaaatcagaaacccggaaacttattgaaaaatttgtggatgaaaatccggatgcggcagcacttctgcttcgcaactggttaaatgatgattgggagtaatttatgaacaacgaatcatatactggagtacagaaagcagcgattcttttgattacgctgggaccggaaaaggcggcaaccattttcaaacatttaaaggaagatgagattgaagaattaacgctggaaatagcgaatacaagaagcgtatcgccacagaccaaggaggaagtgctggaagagttttatcaggtatgcctcgcacagcagtatattgcggaaggcggtatcggatacgcaaaagaacttctggaaaaagcactcggaaacgacaaggcacagggagttattgcaaaacttacagcatctctccaggttcgtccgttcgaatttatccgaaagacagatccggcacagctgctgaactttatacaggatgaacatccgcagacgattgcgatgatcctttcgtatctggctccggcacaggcgtcccaggtactgggagctctgccaccggaaaaacaggctgatgttgcaaaacgtattgcaactatggatcgtacttctccggatgtgatcaaggaggtagaacgcgtactggagcggaaacttgcatctcttgtaaatcaggattacaccatcgtcggtggtattgatgcaattgttggcattttgaacagtgtcgaccgtggaacagagaaacatattatggaatccctggaaatcgaagagccggaacttgcagacgagatccgcaaaaagatgttcgtgttcgaggatattcttctgctcgacgaccgtgcaatccagcgtgtgctgcgtgatgtggaaaatgcagatctggagcttgcgcttaagaatacaacggaagaagtacagaatgtgatctacaagaacctgtcaaaacgtctggcggcaatgatcaaggaggatatggactttatggggcctgttcgtatgaaggatgttgaggaggcacagcagaagattgttgctgtgatccgtaagctcgaagatgccggagagattgtaatttcacgtggcggaggtgacgatatcgttgtctaatttactgaaacaatgttatgtcgtcagttcgggaactggtacaagaattatcaattccaatgacggggtacgccagaaattaaaagaactgcaacaggaacaggctccggaacaggtagatgtatcagcagaggacggacaggagaatgcaccggctggtttctcacaggggattcaggcaaaaaccgtgcagattgatgtggaagccctgcgcagggaagcacttgaaaaggcagctgtggaggcagatgagattacttccacggcaaaagaagatgcagaacgtatccgtggggaagcggaagaaaaagcccgtaccctgtatgaagaacaaaagaaactcggatacgaagagggtgccagatgccgggaagaagaattaaacagggaacatgagaaggcgatggagtctcttcatgcacagaaaaaacaactggaagaacagtatcatgaaaaaatgtcggtgatggaaaaagacattgtggacgctgtgattcaggtatttgataaagtgtttaagattcagtttgaagagaaacgtgaacttttacttcagctggtaaatggagcattacttgacattgacccgggagataaaatacggattcacacgaaccggagcgatgaggaaatcctcaaagaacatcttgcacagatgcaggatattgtaggaaaagatgttgccattgaatttataaaggataataaattatcggatggacagtgcaaaatagaaacaccgtatggcgtggttgactgtggggtggacacacagttgtctgcactgctgaaggatatacgttcactggtataaacgggagacaaatttggttaaagaagcggaaaagtatttacagctgatggaccgccagtattataagagttatggaaaagtagtcaaggtagtaggtcttaccattgaatctgtcggaccaaaggcacgtatgggagatttgtgtaaaatttacccgaacgaaaaggaagaggaatatgttatcgcggaagtggtcggttttcaggattccagactgatcctgatgccggttgacagcgtggaagggggtggaaccggatgcattgtggaaaataccggacatcccctgtcagttctggttggagaagaactgcttgggcatacgctggatggaatcggacgcatgacggatggaacggaagaaattcacggttcgtattatccgttggaaaatacgccgccggatccgatggatcgccggattatcagcgaggtactgccgcttggcgtaaaagcggtggacggactgattacggttggaaaaggacagcgtatcggtgtgtttgccggttccggtgtcgggaaaagtaccctgcttggcatgtttgcaagaaatacgaaggcagacatcaatgtaatcgcactgatcggtgagcgcggcagagaggtccgggaatttattgaacgtgaccttggtccggagggaatggcacggtctgttgtcgtggtcgcaacgtcagataaaccggcactgatccgtaataagtgtgcaaagactgcaacggctgtggcggaatatttccgtgatcagggaaaagatgtactgcttatgatggattccatgacacgattttcccaggcacaaagagaaatcggacttgcatccggggaaccaccggttaccagagggtatccgccgagtgtgtacgcacagatgccaaaacttctggaacgtgccggtacaaatgaaaaaggatcgatcaccggactatatacggttctggtagatggagatgattttaatgagccaatcacggatacggcgcggggcattctggatggacatattgttctcgaccgtaagctgggacataaaaatcattatccggcaattgatattttacagagtatttcccgtgttatgaattccatcgtaacaaaggaacataaggcacttgccggaaaattaaaacaggtgcttgccacatacagtgaagcagaggatctgattaatatcggagcctacaaaaacggatcgaatccggatattgattatgcaatccgaaagaataaagaagtaaatgaatttctgtgtcaggatacggaagaaaagtttgcttttgatgaagaagtggaactcttaaaaaaggtgtttgacgactgatcaatggacagaggttttaaatggcaaaatttgtttatcgtatgcagaacatactgaacattaaacagaaactggagacacaggcgaaaatgacatacagcctggcaaaccagaaatatctggagcagcagaagattctgcaggaatatatggtgcgcagagtcggatatgagcagcactggaagaaactgatgcagggaaatttaaatctgcaggaagtcgaacatgcgcgggcagatgtaaatgccatgaaaacgattgtcagacgacagatggtagaagtccacaaggcggaaaaagaactggaagatgccagaaaccgcttaaaaaccgtgatgcaggaacgaaaggttcaggaaaaattgagggaaaaggcatttgaagaatttaagcaggaacttgcagaagcagaaacgaaagaaatcgatgaacttgtaagttatacctataacaagggtgaacagggagaatgatatggcagacgaaagaaaccttgtcgacgaggaagacgcggtaaaggaaaacagcacaaaaaatcgaagagaaaagaaaaaacgggaaaagaaagaaaaaaaagaaaaaaagaatgccaaaggaaacgcaccggaaccgggagaagatgaggatgaaaagggaggcggcaggctgattcttgtcctgacaaccattttaatcattgcgatatggatgggaattataggaattctgattaaaaccgatgtcggaggatttggatcaacggtgttatatccgcttttgaaagatgtcccttatgttaataaaatcctcccacagccggaagaaacggtggagcagaccgagggcacagagcatcagtatgggtctttaagcgaggccatcagccagattaaagaactggaaaaagaactcgatgaagccagcagtacaaataaaaatgacaaaaaaaagatcaaggatctgaaggcacagatcaaggatctttcaaaatacaaagaggatgaggctgcctttgaaaaggagaaggaaaaatactacgaggaggttgttttttccgatcaggcacccgatatacagcagtataagacatattatgagagcattgatccagaaaatgccgaagtcttatacaaacaagtggttgaacagattacctacgatagtcaggttgaagattacgcaaagacatattccaacatgaagcctcaggaggcggccagcatctttgatacgatgacggacaatctggggcttgtggctgacattctcatgaatatgggaacacagcagagggcggatattcttggcaagatggatgcaacgactgcggcgaagctgacagagatcatggaacctagcaagaaaaagtaggaaatctgtaaatgacagaaaggaggaacgtgtttgacaagtgcaaatgtatttaatttgaattctgtaaagcagggtcaggtattaaatgcaaatgctgcaaaaggcagatcaaaagctgaaaatccggatgcggcaggcgtgtttgcttcactgatgggcagtaactactctacaaattttaatatgccgtccgtggatacaaaaataaacaacaatgtattacagcagacaaatgcggcagataattacgaccggtatcagtatcaggataataccatccgtcaggcagccggagatgttgtcacagacgtgattaacaattcgacagatactttggatcagttccagagtgatgttgtcaggacggtggccgaacaattgggtgtttcggaagattctgtaaaagatatgatggagtcgctgggacttacagcttttgatctcctgaatccggaaaatcttgcacagcttgcaatgcagctgacaggagaaacttctccaatggatttactgatgaatgaccagtttcaggggctgatgcagcaaatggaccagctgggagggcagcttgcaaatgaactaaatcttcagccggcacagatggaggaactgattgcgcagatggatattctgcagacaccggaaactctgaccgatgaagaaatgcaggtattgaccgatgtggcaggacagcagacaacagcagatactgtttcggcagatgtgatgccggagcttgcacagactgatgaggtacagccgatggataaacaggcggatgtatttcagaaagaaccaaaatcggatgaagtacgcacacagcagccacagacaaaggagacaaagcagacagcagaacaacagacgatggaacagcagacggatgccggagatgcagattcgcagacaggggatcaggtgaagtcggcgcagccggaaaaaatgacggcagaccagaccagctctgatgtggcaaagacacagactgccatgcagatgcaggataccgccggggtacagacgatggcgcatgcggcggatgtaacatccgagacatcgtatatttctgtggataccatggatttgctggaacaggtggcagagcagatccgtgtgaatgtttcgcaaggaacttcatcgatggagatgcagctgaatccggaaaatctcgggaaagtgtatgtaaatatttcttcgaaagaaggcatgatccatgcacagctggcagcttctaatgaagcagtccgcgcagcccttgaaacgcaggtggcagatctgcggcagaatttaaatcaggcaggtgtcaaagttgacgccatagaagtaaccgttgcttcccatgaattcgaaaagaatctggaacagaaccaggagaatgaaaagcagcagggagaaagacagcaggagcagtccggaggcagaagaagaaacttaaatctttcctcactggatggattgtcaggactgatgacagaagaagaaactcttgcagcacaaatgatgcgggagaatggaaattccatggatgtaaccgcatagaaaggagaaaaaatggcagatacgacaacttccgcactgaattgggcaactgtggaaaacggaaaagtaaaaacgacaacatcgaaaaaaagcgatgagtccaacaacggaaccatgggatatgatcagttccttacattactttgtgcggaaatgcagtaccaggacccgctcgagcctaccagcaataccgaatatgtggcacagcttgcaacgttctcacagttagaggcaatgcttggcatgcaggatacacagaaaaacgagatggcaaacaatctggttggaaaatatgtaatcttaaaggtttcggacgaaacaaccggaaaaacttcttatgtggacggtaaagtagattatgtcatgtatcaggaagacggatcacagatgctcagtgtcaacaataagctgtattccatcgatacgcttgatacggtggccgacagtgattactatgaagcgattggttatgccaagaccatttcaaacatgctggcacagcttccggatattgaaaatattacgaccaagtattccggtgcgatagaacagatccgtaaggtatacgatggcatgacggattatcagaagagctttgtaagtgagtctgatcttgcaaaactgaagaagtatgagcagaagatcaaagatctgggtggagatacctcagacgatacaaagacggatgataccaaaacagatacggatacgaaaaccgatgataccaagactgatacggataccaagaccgatgacacaaaaacggatgactcgaagacagagaatggttccggtcagaagagtgacgagacaacaggtgcataggaaaggggagaaaaaagatgaacccgatcagcaaacagttttcgtcgatcgaacaggtaaccggccagtatttaaaacagaaaaacgtaaccagtccgtcaaagacgtcggatgtttcattcgaagatgtcttacggcaacagcaacagttaaagttttcaaagcatgcctcgcagcggctggaaagcagaaatatcagcttatccgaggaacagaatgccagactcgaagacggagtggaacaggcacatgccaagggaattaaggattctctggttttggtggattcacttgcttttattgttaatgtgccaagtaaaaccgttgttactgcaatggatcagacggaaacacaatcaaatatttttacaaatatagatggcgcagttattatgtaaccggaccttatggaagttacaggaatcccgactgacagaaggatttcaaaaccatattgccatctaaggaggtcaatgtactatgatgagatcattattctctgctgtgtcaggtcttaagacacaccagacgagaatggatgtaattggtaacaatattgccaatgtaaataccgaagcgttcaaagcttccagcgtaagattcagtgaactgatgtaccagacaatgtccaccgcatccggtggggatgcgtcaaccggtacgggtggtgtcaatgctaagcaggttggtcttggtgtaagcacggcatctaccatgatcaatattaccggggcaggttcttccgagacaaccggatacccgtttgatttaaaactcagcgacagccagaccacaaacttctttattgtcagcgatggaacaaataccatgtttacccgtgcaggttcgttctatgtagatggaaatggctatctgtgtatgagttctaccggatacaccgtacagggatggcaggtagacaaaacgacaggtgagatccacaaagatacggtttcccccctgcaggtgatgtcaccgtccaacacgacatccgctccggaggcaacgacagaggctcatgtgcatggaattctggataaggaagataccgatgtcaccggaaaagacggctatgttatgactcttggattttatgatgatctgggatactcttatacggctaagtttgcggtatcgacaccgaagacaactcagggattaggcactggaaataattattttatcagtttaacggatattattgattcgaagggaaattctattgtcacaaaagacgaaaatggaaatgcaataaaagacgaagctggtaagcgtaagatgcttgattcgatctggggagatgacgggaaacaggatgatacgaatggaccgaagggctattatatgaaatatgattccaataagggtacatttgtaagtattggcgatggttcgaatacaacagctggtacgaaggctgtaacggcgaaatccttaaaactttctgccctgggaacacagtatacaacaaataatgcagacggaacgacacaaaaatccaattttaaggacatcaatgtagatttttccacttccaccaataaaggcaatggcggaaagtcaacactgaaagtagaaaaaggaacttctgtcggaaaagaaaccggtaagaagaatggtgcaatgatcggacttgctgtagaccagagcggtaagatttatgcaagctatgacaatggtaacaccgaacttctcggacagatcgcagtggcacagtttgccaatgcttccggtcttgaaaaaattggtgataactgctatcagacaaccttaaactctggcgagtttgacggtgtgggtgtagctgtggatgcggatggaagcaagatcaattccggacagctggaaatgtcaaacgttgacctttccggacagtttaccgatatgatcattacgcagcgtggatttcaggcaaattcgcgtgttatcacagtttccgatacattactggaagaattaatcaacttaaagagatagtttgaaaaaatagttgggaaatggttttttgactgtttcccaacatttttttgtgattttataccctttttaacaaaaaggaagtagacaagagagagaaagtttagtaaaatcatataaaagggtattttgatggattttgtcggaagatccatcggaattcctaattttagaaaatggaaggtgtagttcatggatatagcatcactgctttcaattatcggcggaattgccatggttatctttggcgtcctcagtagtaacagttttgacatcactgcgatgcagatgtacattgatccggcatctgttgtcattacgtttggtggatctatctgtagtacgattgggtgtttcaagcttgcagatggaatcaacggattcaagtcaatttcactcccgttcaaggataaaacatatgatccgtcacagaccatccggacaattattgacatgtcaaatgtcggaagaaaagaaggtctgcttgcacttgaagaagctgcaaacggaattgaagacgaattcctgaaaaaaggaatcatgcttgtagtagatggcaccgatccggagctggtccgtgggattctggaaacggatatggtgtgtctggaaacccgtcacaaggatgtgattaagttttgggaaaaatggggcgagatgggtcctgcctggggtatgattggtaccctgctcggactgatcgccatgttaaataaactttccgatccgtctgcgatcggaccacagatgtctgtagcactggttacgacactgtacggttccctgattgcaaactggttatgtgccccgattgccggaaaactttccgtaaacaatgatatggaagtggtaaaccgtcagatcaccattgaaggtttgctgtccattcaggcaggagaaaatccacgcgttattgaggaaaaattaaagtcattcctttcaccgactgtaagagagggtgttcttgaaaacggcggaggaggtgaagagtagtggcaaaaaagaaacaggaggatccgccaaaaggagcgccggcatggatgaatactttctcggatctgatgaatcttttgctctgcttcttcgtactattgttttccatgtcgacagtagatactgacaagttagaggcggttgttgcatcactgcagaacgccatcagcatccttccgaccggcggcacaagcattggagagggagagatgatttctgccggtgtccgccagctggaatttctggattcctactacaatgagatggcaaattccaaagcagagaataccgatgagcagacagatggcaaactgtctgcacaggaacagtacgagcagcagcaacttgcggaatctgaaaagatggcagatgaaatccaacaggaacttgataattcacagctgtccggaaaggtggatgtggatttcaatgcagagtatgtaaaactgaatctgaatggttccattttgtttgcatccggtaaggctgatctcgttaaacaggcagtcccgattgtaaacaagcttggaaagattcttgaaaaatataacaagaatgtgatagagatagaaggacataccgataatgttccgatccgctattctgcaaaatatgaaaataacgaggttctttcggtgtaccgtgcacttgctgtcacggatcagctcagaaaaaataaaaacttaaatcccaagtacattaagtttgcgggaagaggagattacataccggttgctgacaacagtacggcagagggacgtgcacaaaaccgacgcgtagagataaaaatttataactcattcaattcagatgtgaaagaaaataactaagaggagtaagcaatgaagaagaatttaatttcagttgtcattctggcacttgtgtttgcaaattttgttttgacagcacttttgatgttttcggtattaccggagacaaaaaaagcaaatacactgatcgaaaaagtgtgttccgcaattgatctggatttaaacagtggtgcggctaccggaaccagcaatatttccattgatgatcaggaaatttataaagtcagcgaaggggaagacctgacaacaaaccttgcagaaggaaaagacggaaagactcattatgcagtactgaatgtatcacttgttctgaacaagaagagcgacaattacaagaaatacacacaggatttcctgacaaatcaggatgatacaatcaaaaatgatattatcaaagtggtaagtggatatacatttgagcagtttaaccagaattcagatgcaattaaggacacgatccttgaagatatgcagaatttattcggcaaagattatgtgatcggagtaaacttctccaaactgacagcacaataggatttttacaggtggtgaaaaactgatgggtgacgtattatcccaaaatgagatagacaacttgctggcggcacttagtaccggtgagctggatgtggatgaaataaaagacaataatgaaaaaaaggtaaaagagtacgattttgcccgtccttccaaattttccaaggaacatctgcgtaccatggaaatgatatttgaacattatggcagacttttatctacgaatctgcccgtgtatttacggaaaaatgttcaggtagaggtggtgaattcagaagcggttacgtattctgaattttctaatgcgctgtcgaatccggttcttttgggaattgtgaattttgcacccctcaagggaaatattattttggaaatggcatcgaatctggggtatgcgattgttgaccgtatgctcggtggcagaggagatcctatggacaaggttcgtgagttctcggaaatcgaacttttgattatcgaacggattatgattgtgtgcgtcaaccttttacgggaaccatgggaaaacgtggcggatattcatccccggttagagagaattgaaaccaattcccagtatgcacagattatttctccgagtgaaatgattgcgattgtgacaattaaccttaagatcggggaagtggaaggcctgatgaatgtttgtcttccgtacctgactcttgaggatgtcattgataagctgaatacgaagtactggtattcaaatctgcagaatcaggacaataccgattacacggaatccattgagaccctgattcggcgcgcacagataccgatcaaagctgttcttggaaacagtatgatatcggtaaatgattttgccatgctgcagccgggagatattatccggctggatcgcaaggtggaggacgaattggatatttatgttggaaatattcggaaatttactgcacttcccggatcatcgggggataaatatgcagtcagggtcacttcggtgatcagagaggagcaataaactatggatggagtattatcgcaggaagaaattaacgcactgctgaatgaacctggagcagaagcgagtgattctgcggaaaatgaactgtctgatgcacaaaaagacgcgatcggagagattgccaatataagtatgggaactgcggcgacaacgttgttttcgctcgttaaccataaggtggaaatttcaactccagttgtttcttacggcacatgggatgacattgtacaggagtatgaaaaaccctgtgtgtttatccggattgcatataccgtaggactggatggaagcaatattcttgtcctgagggaacatgatgtaaaagtcatcacggatctgatgatgggaggagatggaaccaatacagatggcgaacttggcgaattgcatttgtccgcaatcagtgaagctatgaaccagatgatgggttctgcggcaacttccctttcttccatgttaaaccgcaagattgatatcagcccgccaaatgcaacggtgattaatctgcaggaagacatcgatgaagcggagattgattccttccttaccggaaagtttgttaagatctctttccatatggaaatcggggatctggttgacagtacaattatgcagctgtatccgatttcatttgcaaaggatatgtgtgatggagtggcaaaaacgatggaaatggacagtcagagtgtgacggccgattcctcagcagcaaattccggcaatccggcaggggcacagccagcagctgcatctgccgcagcacagcagtcacagcagatggcttcacagaatacagcacaaatggggcagccgatggggcagccgatgggacagacgatgatgggaaatactatgatgaatcagaacatgggacagccggttaatgttcagccggcacaatttagcgcatttgcgggtggaaaccttggaaattaccagccggaaaatattgatctgattatggatgttccgcttcaggtgacagttgagcttggaaggacaacaaaatccatttcagatattctggatctgggaccgggaaaaattattgagttgaataaactggcaggcgagccgattgatgtgcttgtcaatggaaaatatgtcgcaaagggcgaagttgtcgtcattgaagaaagtttcggtgttcgaatcacggaaattgtcaatgcttcaagaacaggcggaaagtagaaacagacatgacaaatgtgttactgacaggttctctggaaagctttatacaacttttgggtgcactgtttatttttgctgttgttctggctgctacatatcttaccaccagatggatgggaggtatgcagcgtggacaccagaataataagaatctgcatgtgatagagacaatcagtgtcggcaataacaagatgatcagtattgtggaagtcggcagtgtctatctggttgtttctgttggaaaagaggaagtacatcttctggcacagcttacgagggatcaattaaaagatttctcttttgagctggaacagagtgggaaaaagcaggattcttttgcggaaattctcaaccagttaaaagacaagttaccaaagaagcaaggataaagatgagcaaagggaaaaagatatactgcattgcaagttttgcgtttgcgtgtgcggttttaatacttacaattacattatgcatgatgcatccgggacgtgtctatgcaagttccatggacccggacagtattacaaagattacacagaaagatacacagggagcagatcataatacagacaatgccaatggattgtcaattacatataacaatgattccggatcggtttccacaccgatcaagatgcttctggtgttgacaattctatcacttgcaccatcgattctgattatgatgacttcgtttacacgaattatcattgtacttcatttccttaggactgcgatcggaacgcagacgacaccacccaatcaggttttgatcggtctggcattgtttctgacattttttatcatgtggccaacgttccagcagatcaacaaagaggcaattcagccgctcgataagggagaaatcacacagtcggaattttttgaaaaagcagaagggccgattcgtgaatttatgatcaaagatgcaaagatccagataagggatgtgaatctttttgcggagatttccggagaaacgtataaagatacaaaggaattgtcggatgttccgtttaccacactggttccggcattcattctgagcgagcttcggaaagcattcattatgggatttttaatttatattccgtttattgtaattgatatggtggtgtcatccgtgctgatgtccatgggtatgatgatgcttcctccgacaaccatttcgttgccgtttaagattttgttgtttgttctggcggatggatgggatcttgtcataaaatccctcgtccagacattttattaggaggataccgtatgatttcacagggtgcagttcttgatattgcaagagatgcaatttataccattctgatcacgtcggcaccgctgcttctggtttctctggtggttggtctgattatcagtatttttcagacggttacatccattcaggagcagacacttacgtttgttccaaagattattgcggtatttgctgcaatgatcctttgcggctcctggatgttaaataacatgaccgaactggtggagcgtctgtggtcgaattttagtacctatctgagtatgtgatttgataaaaagatatggttaattatgtatttacacttgaaaattttgaatattttctgctgattctggtaagagttacctgttttgtgtatgtggccccgttattggggcagcagggaattcccaatcagattaaaatcggattttcattttttgtctcattgcttttatacaatgtagtagatcggccggagctgacatacgcaagtgttgtcgggtatgcggtagttgtgatcaaagagggaattacgggactgctgattgggtatgcggcaagcatctgtaattccattgttttgtttgcaggaaatattatagatatggatattggtctgtccatgtctaccgaatttaatcaggacatgggaacagaaaccacactgacaggaaatctgtattattatctggttctgcttcttttgattacatctgatttttatacctatctggtacgtgcggttacggattctttttccgtaattccgattgcccaccagaaatttgcatgggatcatctgttatctgcaatcacacgctatatgggagattcattcatcatagggtttcggatttttcttccgttttttgcctgtattatggttttgaactgtgtacttggaattatggcacgtgtggcaccgcagatgaatatgttttcaatcggtatgcagctgaagattctggttggatttgttgttttgtatctgatcgtgttcctgttgccgaatgtggcaaattatatttttgatgaaataaagacgatggtgaagcttgttgcagaaggtttgtattgacgaaaaaaatcagaatcgaatattgcattataatctgcaatggtttgcaaaagacggcgaaggcggcgagaagacagaacctgcaaccgccaagaaattaaaagatgccagagatgaaggtaaggttgcaaaaagccgcgaactgaattcggcatttgatctgatcgttttgtttctctgtctgaaaatttttgtttcctttgtgggagagaaattcatagatattttttcttacatctatgaaaatatgccggattttgttaaaataaatgagggcggattgtcggtacaggctgtggcaggcctgattgcctccgttactttaaaaagcctgctcattatgcttccgtttatggcgtttggatttgttgttacgcttctggtcagcattgtgcaggtaggatggaaagtttccacaaaaccaatgaaaccggaactttccaagctgaatccattgaacggattcaaacgtatcttttcgaaagattcgctctttgaactggtaaaatccattttaaagattgtgattatcatatatatcgcgtatacttccataaaagataatgcaaatgatctgtttgcgttgtatgatctgggactgaatcaggcggttgcgcttgtggggactctgattatcaatacgggaataaaaatcagtattgtttatcttgtgattggtctggctgactttatctatcagaaacataagtttaatgaagatatgaagatgaccaagcaggaagtaaaagatgaatacaaaaatacagagggagatccgcagatcaaaggacggcagcgccgtaaaatgcaggaggtatcccagaagcgaatgatgcaggatgttcccaaggcggatgtagtcatcacgaacccgacgcattttgccgtagcattgaaatatgaggcggaagtcagttctgccccggttgtccttgcaaaaggagaagattaccttgcgcaaaagattaaggaagtggcgagggagaataaaattgaaattgttgaaaataagcctctggcacgtatgctctatcacaatgttgatgtgggagcagaaattccgccggagctttaccaggctgtggcagaagttcttgctgccgtatacaaggccaaaaatatacagtagtgcagttatacaacaaacaggtgcgaaaggaggttgtgcaggatgctgaagaaagcggatattggtgtaggtttatatcttttggcggcagtagttttcttcattgttccaattccatccgtattgctggatgtgatgcttgcatttaacatttccatcgccttaattattgtatttaatgtattgtttgttcgggaagtactggatatgtctttcttcccgacattacttttgtttacgactatttttcgaatttctctgaacgtatcttccacccgtctgattcttctgacgggagatcctggtaacgttgttaagacattcggttcgttcgtcggtggaggaaatatggtggtcggttccattgtatttattgtcctcgtattgattcagtttattgttatcaataaaggttcggaacgtgtatccgaagtaaccgccagatttacactcgatgccatgcctggtaaacagatggcgattgatgcggacttaaataccggtgcgatcaccgatgcggaggcaaaggaacgacgggaaaagattcagagagaatctagtttcttcggcgcgatggatggtgccacaaagtatgtaaagggagatgctacggcaggtctggtcatcacctttattaacctgatcggcggaaccattatgggagttatgaatcagggacttggatttgcagatgccatccagcagtatggtctgctgacaatcggtgatggtctggtgtcccagattccgtctcttctgatttctcttgcaaccggtatacttgttaccaagggatcaaacgaggcagacttttccggaattctggtcaagcagctttttggaattccgagggtactttatattgtaggttccgtgctggttttcctcggaatttttactccgttaaatccggttttatttattgcacttggtctggtgtttatcatcgccggcaaaaatatcagcaagaatatcggcgaagaaaatattgaggaagaagtacagcaggcggagacggaggcggaagagatccggaaaccggagaatgtggtttccctgcttcaggtcgatccgatcgaactcgaattcggatatggtattattccgctggcagatgtaaaccagggtggagatcttctggatcgtgtggtaatgatccggcggcagattgcactggaacttggtacggttgttccgattatccgcctgagggataatatccagttaaatccgaatcagtacattatcaagatcaaaggcgtgcaggtaacggaaggagaaattctttttgatcattatatggcgatgaatccggggtatgtggaggaagaaattacaggtattcctacatttgaaccgtctttccatcttccggccatctggattacggaagcgcagagagaacgtgcagagagtcttggatacaccgtagttgatgcaccgtctatcattgcgacgcatttgacagaagtaatccgaagccacatcgcagagcttctgaccagacaggatgtacagaacctggtcaacaacttaaaagaatccaatccggttcttgtggacgagctcacgccgaaacttcttggccttggagagattcagaaagtactgcagaatcttttgcgggaaggcatttcgatcagggatcttttgtctatttttgaatcgctggcagatcatgcacagacatccagagatacggatgtgctgacggaatatgtaaggcagagtctgaagcgtgcaatttcgagcaaatatttcccgtcgaacgaaacgaccagtgtcattacgctcgatccgaaagtggaacaggagatcatgtcttcggtcaagcagacagagcagggtgcatatctgacgatggacccggagaaaacaaaagcaattatggattccgtgcggacagaaaccgagaaactcgaaagccttggaaagaatccgatcattattacatcgccaattgtgcgtatgtattttaaaaaactcacagaagattatttcaaagatctgattgttgtctcttacaatgaagtagaatctgatgtggagctgcaatcggtagggatggtgacagcataaatgacaattaataaatttcagggaaaaacacaggaagaagccattgcaaaggcaaaagaagaatttggagaacgcgcggtcattatgaacatccgtgaggtaaaaccgaaggggctgtttcgtgcgtttaagaattcaacatttgaagtgactgcggcaatggaggaaaaagaacatttttccaatgccatgcaggcagcacagatgacacagagtatggcaaaagaaggaaaactgcacgacatgatcaatcttgcggcggatgaaccgattaccattccgaaactgcaggaacaggaaggtaacgcacaagcgaccagacaggagccagcacgtatgccacaatcacagaatctggtacaggaaaatgaagagaaaaaattagaagaaagacttgaggttttatctgaccgtctggaaaaatctcttggcgggaaaaatccgaaggagccggagacaccaaagggtccgtcttcggaggaactcaattttgtccggattctctacagcacgctgttgaaaaacgaggtgagtgaacagtatgtcaatcagatccttggcgaaattgaaaaatttatccgcccgggacacagtgtggatacgattctttccaatgtttaccagaaactgattctgcgtttcggtcagccgaaatcactggatttaagcggagcaaaaccgcatgttgtattttttatcgggcctaccggcgtcggaaaaacaacaacaatcgccaaaattgcttccaaatataaagtggattatgaaaaaaaagtagcgtttattactgcagatacctatcggattgcagcaacagaacagcttcaggtgtatgcaaatattcttgacgcacctatgtctatcgtgtattctaaagaggaactgaatgaagcaattgaaaaatatgcggaatacgatcttgtttttgttgatactgctggattttcccataaaaatgaggaacagaaagaagatatcagaaacctgattcagggagtcagccctgaatatacaagtgaagtatatttggttctcagcgctacaacgaaatacagagatttgcttgatattgtagatacctatcgcacaatatcagagtttaaactgatttttacaaaactggatgagacatcaacgtatggaaatttgctcaatattaagctgtattcagatgcggaactgtcttatacgacaaatggacagaatgtaccagatgatattgaattattcgatacacaaaagatcgtgaaacaattattagggggcaattcgtgatggatcaggcagaacaattgcgaaatgtaataaaactgcacaatcagaataatcagaataatgcacgcgtagtgacaattaccagcggaaaaggcggagtcggaaagtcgaatcttgcggtaaatcttgcggtatgtctcagaaaagcaggcaagcgggtaattatttttgatgctgattttggtcttgcaaacgttgaggtaatgtttggcgcaattccacagtacaatttgtctgattttatataccgtggaaagtcaattcgtgaaataatcacaccgggaccgatggatatcggctttatatccggcggatccgggattataggattgaacaatcttacaaaagaacagattttatatatcgtaaattcgattgacacattgaatgaactggcagattttatcctgattgatacgggtgcaggaatctcggatcaggttctggaatttgttatggcaagtcctgaggtattactggtatccacaccggaaccaagttccctgacggatgcgtattcgcttttaaaagcattgtactgcaatcccgattttgtggaggaagagacaaccatccacatagtaaccaaccgggtaaattcccgggacgagggacaggcaatttatgagaaagtgaattccgtagtgtctaagtttttacatggaagtctgaattatctggggatgattccacaggatgctgctttggaacgggcagtaagacagcaaaagacagttaccatgagtgatccgaatgcaaaatccgcaaaggcaatttcctgccttacagatcatctgttaaacggcacccagcagaaggcaccggtacggtggggaatagcacagatgttttccagttttttatcaaaccgaaaatagggagatgaataattatgaaactttcagatgtgattactccgggagacaaaattgatattaaaatgctgcatgaagcgaaccaggaagataatggaggagagatcgcgaaaatctatcaaagtgtggtcagcgacattttttcggatcaggaattggaaatttctatgccgacaagtggtggaagaatggtgttatttcaactggagagggagtgcagcattgttttttatacaaaaggcggtatgtataactgcacagcagttgtgaagaaacgttatcgcaaagaaaatctgtatctgcttagaattgtgattacttccggattacagaaatttcagcgccgggaatttttccggattccttatacgacaccgttaaaatattacgaaatatcggaacagacggcacagatgcagacaacggaagaattgtttgcggaaattcaaaagccggaatatattgatcaggtacgtgagggaacgattcagaatatcagtggcggtggaatccgctttgtctccggacaatggataaaacagaaccaaaatattcttctggtgatcagactgacaaatgaatattcggatgaaactttttatcttccgggacaggtgattgcaacagaaaaacatccagcgatagaggaaatgtacattcaccgggtaaaatttctgttccgggatctccgggaccgggaaaaaattgtacgcttcgtttttgaggaagagagaagaattcgcaggaaagaagttgggtgactcatatgaaaaaaaacattttggtagttgatgattctgcactcatgagaagggtcatgtgtgatataatcaattcagacagtaaatttcaagcaacagactattgcagagatggtcttgaggcatatgaaaaactgaagcataccagttatgatggtgtggttctggatgtgaatatgccacgcatggatggactgcagttactcgaaaagttacaaaaagaaggcatacgtgcaaatgtggttatggtaagtacacttaccgacagcagggaagcagatgttaccattttagccatggagcgcggagcaattgattttgtggcgaaaccgacaaacatcatagaggcaaaaggagaggcattcaaaaggcagcttctgggtgttctggatgctgtccttgcaacacaaaaaacagcaggaggtatccgtgtggcagcaaaaccggcagcaaaggcaccgatgatgcgcaaagcgacaggcggaaagaacaaactggttgcactggcttgttccacaggcggaccgaaagcgttacagagtgtgattccgtttcttccgaaagaactggatgccccggttgtacttgtacagcatatgccgccggggtttaccaaatccatggctgacagacttgatgatctgagcaaaatcagggtgaaggaagcagagcatggagagcggctgcaaaagggatgtgtttatattgctccgggcggaaaacatttgaaagttgcaaaaaccgcagacggaaacaacagcattgtactcgatgatgcaacaccggcaatcggaggactgaagccgtgtgcaaatcttatgtatgattcactgacgggaagcagctatgatgaaatcgtatgtgttgtcctgacaggaatgggagcggatggaaccaacggaattctttcgctgggaagatcaaaaccgattcgcgtaattgcacaaaacgaagaaacctgtgtggtatacggaatgccgaaggcaatctatgaagcaggtgtggtagatgaagttgtaccactggatgaagttgcacagacaatcacaaaaaacgtgggggtaaaataacatggatgtaagccaataccttgaaatctttatcgatgaaagtgcagaacatttacagacgttaagtgactgcatcatggaactggaaaaagaaccggataacaaggacgttatcaatgaaatcttccgtgcagcccattctttaaaaggaatggccggtacaatgggatttaagagaatgcagcacctgacacatgatatggaaaatgtgttccaggaagtccgcagcgagaaaatccaggtagacagtcagatgattgatctgctgttcaagtgtctggatgcaattgacggatatcttgaaaatattaaggcaacctctgatgaaggggaagaagacaatgaagtcattatcaaggaactgaacaatttcctcgcaaaagcaaacggagaggctgctgccgcagaggcagcacctgcagaaacagaaaaagaagcagcggcgccgacagacaatggagaccacaaactgtatcttcagattgatctgacggatcaggagcgggatgccgttatgactgcaaaagacagtggaatgcatatttacggcatgacggttatgatccagaaagagtgccttttaaaagcggccagagcttttttggtattccgcgaagtggaggcttttggagagattcttgtatatcgtccgagctctcaggatattgaagatgaaaagtttgaacaggaattcagcttttatgtcgcatcaccggaaagctttgacaagatccagaacgctgcaaagaatgtttccgagattgaagatgccgttggagaagaactgactgatttttcaccacgcgtaacagaaactgagacggaagaaaagaaagaagaaaaaccggcagagacaaaaccggaagtacaggctgaaccaaagaaagcaccggaaaagaaaaaggctccggcaaagaaaaacggtgtaggaaaaccggcgacaagccgtacggtccgtgtggatattgaaaagctggatgctcttatgaaccaggtatccgagcttatcattgcaaagaacagtctggtatccatcagttcaacggaagagggaggctttaccaatcagggatttcatgaacagattgaatatctggagcgaatcaccacaagccttcatgaatctgttatgaaagtccggatggtgccaattgagagcgttgtaaataaattcccacgtatgattcgtgatctgtcccgtacattgaataagaagatggaactggttatgaccggtgaagataccgagctggatcgtaccgtagtggatcagatcggtgatccgttacagcatttgcttcgtaattctgcggatcatggtctggaagacaccgagcttcgtatccagagaggaaagccggaagtcggaaatattttcctgaatgcatatcaggaaggaaataacgttattatccaggtgggtgatgacggtaacggaattgataccgaagcggtaaaagcaaaggcaatcgagcgaaatattattacaccggaacaggccgaagtcatgacacagaaagagatcataaatctcctgtttatgccaagtttttccatggcaaagaagattacagatatttccggaagaggcgttggccttgacgttgtaaaatctaacattgagcagcttggcggtgatgtggaagttaagacaaaacttggggaaggaacaacatttaccgttcgtcttcctctgacacttgccattattcaggcattgatggttgaagtccgcgatgaaaaatatgccattgcccttgggtccattgcaaatattgagagtgtaccggtcagcagcatcaagtatgtggaagcaaaagaggttattcatctgcgtggaagcgttattccgcttgttcgtctggacaaacttctggatattgaaccaagagaagaagaaccggaaagccttaccgttgttattgtaaagaaaggcgacagtcaggtaggacttgttgttgacgatctgatgggacagcaggagatcgttattaagtctttaggcaagtatatcaatggaaataagctgatcagcggtgcaacaatcctcggtgatggtgaagttgcgttgattctggatgcaaacacactgatgtaatgggggtgaatgacgatggctattgcaaacaatcagattgaaacaaatgagaataaaaataaagaaaaagaagtaaagcagtatatcgtagttcagatcggttctgaaaagtacggaattgatatcagctatgtcgataatattgtgcgtatgcagaaaattacccgtgtgccaaaggcacaggagtatttcaagggaatcatcaatcttcgaggcgaaattgtgccggttatgagtatccgtctgaaaatgggacttgaggatgatacctttacttcggcatcccggatcattattttaaagatcgaagataaagggtctttaggtgtgattgtagatgaggtttgtgaggttgtaaatctttctgaggatcagatcgaaaataacaatatcaattcaaatcatgtaaaagatacttttatcaatggtattggaacaagcggagatcagctgatttccctgtttgaaatcaatgcgattgtagacgaaaaagataacacataagacaactgagtatagtgaggctatgcctcactatacatggttattggaggaaaaagatgaacgattttacattggataatgtaaatgaaatgtatattgacgtactgcgcgaaattggaaatatcggagcgggaaatgcaacaacttctctggcaagcatgatcaatgaacagattgatatgaatgttccgaaagtagaattgatggaagcttctaagctgagttccgcaatttgtccggaagacgagattattgtcggaatttttctggaagtaacacatgatattacaggaagcatgatgtttttaatgcgcatggattccgcccattatcttgtgaacaaactgatgggaagagacccggaaaacgatgcaccttttgatgagatggatttatctgccatgaaggaaatcggaaatattattacggcttcgtatctgtctgcactttcaagtatgacaaatcttacgattttaccatccgttccatatattgcggtggatatggcgggagcgattcttagtgttccggcaattcagtttggacagtacggaaataatgcgctgctgattgaaacagaatttggcgatgaacgtatgattaatggatattttatcttgatgcctgaggaagagtcctatgcaaagattttatcctctcttggaattcagctatagaggagatcgtagaatatgggagaagtgatcaaggttggaatggcagacctgaaaaccgcaaaagctccgaatacactcacgacactggggttgggctcttgtatcggattaacactttatgatccggtgacgaaaatcggtggattggtacattatatgctgccagacagcacaaaattaaaaaataataccaatattgcaaaattcggggataccggaatccgtgaacttttaagacagattctggctttgggagcaaatcagagaagacttgtggcaaagatcgcggggggtgcatgcatgtttgaaacgagcggactttcgtctgtgggaaatgtaggcgcacgcaatgcggaagaagcaaaaattattttgaaagaattaaggatcccgctgatcgcggaggataccggtttaaattacggacgtacggtagaactggattgtgagaccggagatttcagaattaaatcggtgggaaaagaaattaaagtaatatagagggacagaagatgaaaaccaatggtgtaccggctattattatgttggcggcagggtttattgactgtgtgattgcaattcttacgcacatgtcactttggaattttacaagacagctgttactggtacttgtcctgttttatgtgatcggttgtgtggtaaaaatgatcattgaccgaaacttcaaggatatggaagatgaccagaacggggaagaaacggaagagtctaaagaggagcaggaagcggaaggctctgaggaacaggaaaatactgaacaggccaaagatgcacaggagcagtcgcaggagcagccggaggttcaggaggaacaacaaacaaagtaattaaccggggcggaatgatgtagatgaaaactgcggataaagaaaaactctgggatgcgtatcgtcagaagaaaacgcaggagatcagagaacagctgataattgaatatgcgcagcttgtaaaactcgtagcgggaagactcagcatgtatcttggacacaatgtggaatatgatgatttggtcagttatgggattttcggactgattgacgcaattgataaatttgatctggaaaaaaatgtaaaatttgaaacatatgcgagtttgcggattcgtggtgctattttagaccagattcgtaaaatggactggattccaagaagtgtccggcagcgacagcgcaaaattgatgaagcgatgaaacagatcgagatgaggaccggtaaaacagcttcggatgaagaacttgcaaagcagctggggctgacggatgaggaactgtgcagctggcagacacagcttaaggtgaccaatgttgtgtctttgaatgaatttgaagaaaccggtccggagccaatgattgattcggcgcatccggttcggttttcacagccggaagaagtggtggaggaagaagaattaaaagaaaaactggcggaatccctggaacttctgacggagaaagagcggcgcgttattgaactttattattatgaagatatgacattaaaagaaatcagtaaaatattggaagtgtcagaatcacgtatttcccagttacataccaaagcattaaacaagatgcgtaaaaaaatgggtgtttatatgaatattctgacggagtaggagcggatctatggcaattgcaccaatcaattatgctacgatacagcgtaccgcagacatcgagacattcaaaaaccagcaggatacaaaaccgatggtggatcagcagaatattcaggtgcaggtggatcacagggaggatgttctgcatcatcaggtcatccacccggaagaaaatgagcagctggataatcacacagatgccagggaagaaggaaaaaacaaatataaaaaacagggatctgtgagaaaaaaaacaaacaaggaaacgaagcggacgggtggcaatccggttggcggcagttttgatatgaaaatctgagggaaaatatatgacgggtgtggaaattacactgattctggttggaatcatttttgttctcgtaagcttttttgttcaggaaaaacttaccccgaaagatgtacaggagataaccagattaagtgagaaggaattaaagattattgtcgagcgggaactgaaaaatgcaaatgacaaggtagaagatgcaatcgatgcagtggtagaacagtcccaggagaatgccaagcgtctgatggaaaaagaaacgaatgagaaaattatggcaatcaacgaatattccaatacggtgattgaatcaatgaataaaacgcataatgaaattctctttttatataatatgctcaatgacaagcatacggaactgaccgggcttgcatcgcagctacaacagttttcggagcaggtaaaacatacacaggatgaaatgatgacacatctgacggaaacggtaaaagagcctgaaccggcaagaacggaagtgccagagcctgtggaggaacagccgcagcagatttcaccaaaagcatctgtggcagaggaaaccgataacggaagcttcaacgatcaggtacttgcacttcatcaaaacggagtgtctgatgtggaaattgcccgtaagctgggacgggggcttggagaagtgaagctggtgatcggattatacaaaggggaagatgtcagtgagatttaaatattatttacgtggctgcggacttggaattctggttgcctcgctggtatttattgtatcattacatgcacacggcggagcaatgtcggatgaaaaagctatgcagagagcttcggaacttggaatgatcatgccggatgacacacagacgcaggaagcagaaacgcagacaacagaacttccggtaaaggaaacgaatcttccggatacacaaagaacgacacaggcagtgacacagaaggttccgcagaacgatacacaaaaacagacggagcgtgatacttcttcggaacagaatgacacaccaaaagagtcggagaaaaaggcggaagaaaagaaaaaaacaaaggactctcaaaagaaagaagaagagaagaaaaaagcgcaggagaccgagaaggaagaaacaaaaaaggaaaaagtctccattacaataaaaggcggagaagtgtgcagggagattgcacaggatctgcaggagaaaggacttgtcaaggatgcggaagatttccgcaaatatatgcaggatcacaattatgcaagatatatccgtgtggggacatttacgctggaaaagggaatgaactatagcgagattgcgaaagtactgacaaaaaaatagtataataaagcttgcaagaaagcctttggtatgatataatgccaaaggctttaaattttattaaacacatgtatggaagctgccggtgccggatctacgcttttccggtggcagactaataggaagtacatggaagaaatcaaccaaacggaggtaattaaaatgagcgtaatttctatgaaacagttacttgaggcaggtgttcatttcggacatcagacaagaagatggaaccctaaaatggctccatacatctacacagagcgtaatggtatctacatcattgacttacagaagtctgttggcaaggtagatgaggcatatgatgcaatttccgatatcgctgctcagggtggtaccattcttttcgttggtacaaagaagcaggcacaggatgctattaagactgaggcagagcgttgcggaatgtactatgtaaatgagagatggttaggtggaatgcttacaaacttcagaaccatccagagccgtattgcacgtctgaaagaaattgagaccatgtctgaagatggaacatttgatgttctgccaaagaaggaagttattgcactgaaaaaagagtgggataagttagagaagaaccttggcggaatcaaggatatgaagagaattcctgacgctatctttatcgtagatcctaagaaggagagaatctgcgtacaggaagcacagtctttaggaatcacactgatcggtatcgctgatacaaactgtgatccggacgagttagattatgtaatcccaggtaatgatgatgcaatcagagccgttaagcttatcgtttccaagatggcagatgctgttatcgaggcaaagcagggaactgaggaagttgctgcagaagctgctgaggagacagtagaagaataatttttgcataatcattcgagaattggaggaaaaaaagatggcaattactgctgctatggttaaggaactgcgtgagatgacaggcgcaggtatgatggattgtaagaaagctctgacagagacaaacggagatatggatgccgctgttgacgttttgaaaaaaagcggtgcagccaagatggaaaagaagcagagcagaatcgctgcggaaggtatcgcaagagttgcagtaaacggaaatgttgctgttgtagctgaggttaactcagagacagatttcgttgctaaaaatgaaacattccaggagtttgttcagacagttgcagatacagcacttgcttctgatttaaacggtggagcaaacggcgaagatatcgaggcacttcttgctacaaacggactcagtgatctgcttgttgagaagacagcaacaatcggagagaagttatctgtgcgcagattcgcaaaggtaaccggtgatgctgttgcttcttatattcacggtggcggaagaatcggtgttgttatcgctgcagacggtgcatctgatgatgctgcaaaagaggctcttacaaacattgctatgcaggttgctgcaatgaacccacagtatatcagcagaaacgatatttccgctgaggaacttgcaaagatcaaagagatcacaattgacagtgcattaaatgatgcaacaactcttccaaagcctatcttaaacaaattactggacaaggcaatcggcgagaaggtatggagtgatgaggatatcaataacttcgaagagcataagagcaatatgaattatgtctggaatttcctttccgatgctgcaaaggttcagctgggtgagctggctatggcagataaggcgtctatcactgctgagaagatgttcggcggtcttgtagaaggtcgtgtatccaagcagttaaaggagatctgccttcttgatcagacatacgttaaggcggaagatggcaagcagtccgtagctaagtatcttgagtctgtttccaaggatcttaaaatcaccaagatgattcgtttcgaagttggcgagggtatggaaaagaaacaggaagatttcgcagcagaagttgctgcccagatgaacgcataatccgttcacagagtcaagctgtgtgaaaacacataaggagtcgtggttttggaaaaataaagaaaccgtggctccttttttataacaattttacaacaacagggaattaaatctttacaagttttcaaaatatgttaaaatagaaaaggatatttcccggtggaggaacaggatgagtacaaaagattcagaagctctggagcagcagcgtcagaggagaaatcgcatcaaccgtatgaaaacgggaatcattgtgacgattacggtatggatgcttgtctcactgttggcaattatccttctgacggtgcaggtagcacgtttgagcagccatgtaaagagactggagaaagcgggacagacaaccgtttcgcaaaatattccggattctgaaaatgtgcaggctgcggatacagaaagcagtgggcaggagacacagaaatctgcttacgataaagttgtgacggggattgattccgaggacaatatggcaaaagagggagatgcacataaagtatatcttacttttgacggcggaccggatgaaaatacggacaagattctcgacgtattggataaatacggagtaaaagcaacttttttcgtagtaggggatgattccaaggatatgcaggaggtctataagaggattgtaaaagatggacatacacttggaatgcattccttttccaacaaatacagtacaatatatgcctccacagaggcatttgaacaggattttgataagatttcctcatatctgaaagacgttacgggagtcaatagtctctattatcgttttccaggaggaagcagcaatgagatcagcaatgtaaatatggctgaattcgttcgtgtcttaaatgaaaagggaattacatactttgactggaacgtttccgcaggagatacttcatcggattatacggtggatgatgttgtgacaaatgtgacagaaggagtaaaaagatacaaaacctcggttgtgttattacacgacggagatgacaagtcaacaacggtagaggctctggaacctttgattcagaaactgcaacagatgaaagctgagattctgccgattgatgaaaatacaaaagtcattcaatatatcaaggcagatagtgttgaataaatatgagtggaggaagcacgatgggattatttaaagattttaaggatgatttttcccaggcagtcaatgaaatgatgccgggagcagacgttccgggaaaagaaaacaagacagaagatctggtagttaacactctgggagaagatgtggatgtaaaatccgaattatccaaactggatggtttactggagcaggtacaaaaggatgacgggtctgatacacaaaagttagagtcggagcttccaccaattcacaaagaggataaaaaaccggtgatcacaccaactgtggatccggtaatcaatacatttaatgaggagaaaaaaattatgagcgacacaacaatggaaaccccaaagccaacagcaccagtgatgaataacaaagtgaatccggatgcagtttcagatgagacatctgttataaccgcaggaaccgttctgaccggtgatatcgcgtctgacggatcatttgatattcagggaaccatcaatggaaatgtaacctgcaatggtaagctggttgtaaccggaacgattaacggaaacagtgcagcttcagagttttttgctgatgtggcaaaagtagagggagaagttgtaagttccggtacggttaagatcggagccggttctgtgatcattggtaatatttcagcagcttctgcagttattgctggtgcgatcaagggtgatattgatgtacagggacctgttgttgttgatacatctgcagtggtaatgggaaatatcaaatcccgttccgtacagattaataacggtgcagtaatcgaaggtttctgctctcagtgctatgctgatattgatgtgcagggactttttgacggaaagtaaaatcaatcataggagacagatacgatgaaacgtattttattaaaactcagtggagaggcattggccggggacaagcatcatggatttgatgagccgacagttacggttgttgcaaagcaggtaaagcaattggtagatgcaggtgtacaggttggtattgtcatcggaggaggcaacttctggagaggacgtaccagtgagacgatcgaccgtacaaaagccgatcagatcggtatgcttgctacggttatgaactgtatttatgtgtcagaaattttccgttccgttggaatgatgacttccgtgcttactccgtttgagtgcggatctatcacaaagttatattccaaggatcgtgcaaataaatattttgcacataacatggttgtattttttgcaggtggtaccggacatccatatttctcaacagatacggcaacggtacttcgtgcggtagagattgaagcagatggaatttatcttgccaaggcaatcgatggtgtatatgacagcgatccgaaagtaaatccatccgctaagaaatatgatcaggtttccattcaggaagtcattgataaaaaacttgcggtcgttgatctgacagcatccgtaatgtgcatggaaaaccacattccaatgtatgtattcggacttggtgaaacgaacagcattgtaaacgcggtaaacggccagttcaacggaaccgtcgttactgtggactaggaggatatagtatatggacgagagattacagatttttcaggataaaatggagaaatcccttgccaatttaaatgaggagttcgcgggaatccgtgcaggacgtgcgaatccgcatgtgttggacaaacttcgtgttgattattacggaacaccgtctccgattcagagcgttgcaaatgtcagtgttccggagccgagaatgattcagattcagccatgggaagcatctatggtaaaagaaattgaaaaagccattctcagttcggatctgggaattaacccgacgaatgacggaaaactgattcgtctggtatttccggaactgaccgaagagcgaagaaaagagctggcaaaagatattaagaaaaaaggtgagggtgccaaggtcgctgtgagaaatatccgcagagatgcgatggatcatttcaaaaaagtaggcaaggcggaggatatttccgaggacgagatcaaggatctcgaagacggaatccagaaactgaccgatcagtatgttgcacagattgacaaggctgtggatgccaagtcggatgaaattcttacagtataagatgtttaagggacataagcctgtggctatgtccctttttcacttgcaggaaagaggggaacaagattgatgaaaattccaaaacatgtggcgattatactcgatgggaatggaagatgggcaaaaagcaagggtatgccacgcaattacggacataccgttggcgcaaagaatgtagaaacggtttgtcaggctgcagatgagcttggaattgagtacctgacactgtatgcattttccacggaaaactggaatcgtccggacagcgaagtggctgcactgatgaaactgctggagagttatttgaaaaactgtatccgcacggcaaataaaaataatatgcgggtacgtgtgattggggaactttccagattatccgaaagttttcagaaaaagattcaggaactggaagaagtttccgcggcaaatacgggattgaatctgaccattgccatcaattatgggagccgggatgagatgcttcgggccatgaagcatatgtttactgatataaagaatggcagaatcacggaggaggaaatcaatgagaaaaccttttccggatatttggatacaagggaacttccagacccggatttactgattcgtacaagtggagagcagcggctttccaattatctgctgtggcagcttgcgtatagcgaattttattttacggatgttccgtggccggattttcataaaaaagaattggaattagctgtggaagcgtataataaacgagacagacgctttggcggacttaaggaggaagaataggatgtttaaaacgagactgttaagcggaatcgtgctggtaattctggctctgtttttgattatttcaggccatgaaattttattatttgcaacacttgccatttcctgtatcggaatgtttgaattatatcgcgtgttcaagatggaaaagaccgttctggcaggcgttggatatctggcggcaatcgtttattactgtaatttacagtggaagtttctgccggatcttatgattttatttatggcatttttgattctgttaatgtttgtatttgtatttgcatatccgaaatttcatgcagatcaggtgatggcagcattttttggattcttctatgtagcggtcatgctttcttatgtatatcagatccgtacgcttgagagagggttatatcttgcctttcttgtatttttatgttcgtggggatgcgatacctgtgcatattgcgtcggaatgctgatcggaaagcacaagatgtcgccgaaactcagtccgaaaaaatcggtagagggtgcagtgggaggtgtggcaggtgctgcgcttctgaccgctttatattgttttattttccgtagcccgatgcatctggaacgtggagaaattgtaattcttgctgtgattgcggcaattgccggactgatttccatggtaggggatctgacagcttctgccatcaaaagaaattatgatatcaaggattacggaaagctgattcccggtcatggaggaattctcgaccggtttgacagcatgattattactgcaccaatcatttatttcctggcgcttcatatgctgtaagaggtgaacgatgaaaaagatagcaattttgggatcgacagggtccattggaacacagacactttctgtgattgaagaacatgcagatgattttgaagtgaccgcacttgcctgtggaaacaatatccgtctgctggaagaacaaatgcggaaatttcgcccaaagcttgttgctgtgtggagcaaagaggcagcagcttcccttcgggtccgcacggcggatctgggcattcctgtggaaaccggaatggatggattacttgcggttgcaacttatgaagagtcggaaattttggtaacggcgattgtcgggatgctcggaatccggccgaccattgcagccataaaggcaaagaaaacgattgccctggcaaacaaagaaacgttagttacggcaggacatctcattattccgcttgcagcggagtatggagtgtctattcttccggtagatagtgaacatagtgccattttccagtctttgcagggaaatgaagaaaatccgatcagtaaaatccttcttaccgcatccggaggaccgttccggggcagaaagaagcaggatctgctccatatacaggtggaagatgcattaaagcatccgaactggtccatgggacacaaggtgaccattgattcttcgacacttgtgaacaaagggcttgaggttatggaagcaaaatggctgtttggtgtggaactcgaacagattgaagttgtcgtgcatccgcagagtgtcattcattctgctgtagaatatgaggatggtgcagtgattgcgcagcttggaacgccggatatgcgtctgccgattcagtatgcactgtattacccaaagcggaaacatttatccgggaagcgtctggatctttttgctcttcgtgaccttacgtttgagcgcccggatacggataccttccgtgggctttccctggcatatgatgctgccagacggggaggaaatatcccaacggtttttaatgccgcaaatgaaaaggcagtggcaatgtttctggacagaaaaatcgcttatccggaaattacggaaatgattgaagctgcaatggaagaagtcagctatatcgcacatccggatttagagcagatcttagagacagagcaggcaacatatgaatatatagggggcaggtggtaaaaaaaatgaaaattgtatcatttcttatcgcatttgtaatatttagtattgtaattttatttcatgaactggggcattttttgcttgcaaaggcaaacggaatccgggtaaatgaattttgtttcggccttggaccgactatctgtgggatacaaaaaggcgaaaccaaatactgcattaaggcatttccgtttggaggagcctgcatgatggaaggggaagacgaagattcgacggacaatcgtgcatttggtaaaaagccggtatggggacgtatgagcgtcgtatttgcaggacctttttttaattttattcttgcatttattttcgcgtttatcctgatgagctgtgtgggatatgataagccggttctttccggggtaatggaaggatatgccgcagaagaggcaggtcttcaggaaggggatgagattatccggatgaatcatttttcggttcatttcagcagagaaatcactgcatacggaacatttcattccggggaaaccattaaagtcacttatgcaagggatgggcagaaacatacgacaacactggttccgaaactggataaagagaccggaagatatctgtacggatttcagaccatgggaaatgtccgggtaaagggaaacgtgctcacaaacctaaaaaacagtttttatgaggtgcgatactggatttataccactatccagagtctgaaaatgcttgtgacacgtcaggtatctccaaacgaactgagcggaccggtcggtatcgtaaaatcaatcggagacacctatcagcagtctgtaaaaaatgacgggtattactatgcacttttgaatatgctcaactggacgattcttttatctgcgaatctgggcgttatgaatctgctgccgcttccggcactggacggaggccggctgttatttctgattattgaggcgatccgcagaaagcggattgatccaaacaaagaaggcatggtaaatctggttggtattgtattgttgtttggactgatgtttattgttatgttcaatgacattcgaaaactatttatctaagaggctagaggcgttatgatggagagacatatcacaaaggaagtacagattggaaacagatggattggaggaaatcatccgattgcgattcagtctatgacaaatacaaagacagaggatgttgcggcaacggtggcacagattaagcagctgacaaaagtcggttgtgaaattatccgctgcgcggttcccacccaggaggcagctgcggcgctgacggaaatcaaaaaacagattaccatcccgctggttgcggatatccattttgattaccggcttgcgattgcagccatggagcacggtgcggataaaattcgtatcaatcccggaaacattggaagtcgtgagcgtgtaaaagcggttgtggatgtggcaaaagagcgccggattcctatccgtgtgggcgtcaacagcggatctttagagaagggtctcgtggaaaaataccatggtgtgaccgcagagggaattgtggagagcgcaatggataaagtgaaactgatcgaagatatgggctatgataatcttgtgatcagtatcaaatcctcggatgtcatgatgtgtgtcaaagcacatgagctgatcgcaaaacagacggatcatccgctgcatgtgggaatcacagaggcgggaacactgatcagcgggaatatcaaatctgcaatcggtctgggactgattttaaaccagggaatcggggataccatccgtgtttctctgaccggggacccgttggaagagattaaatccgcaaaactgattcttcgtaccctcggacttcgcaaagggggcgtggaagtggtttcctgtccgacctgcggaagaacccgcattgatctgatcgggcttgccaatcaggtagaaacgatggtttcggaatttccgcttgatatcaaagtggcggtaatgggatgtgtggtaaacggaccgggagaggcaaaggaagccgatatcgggattgccggaggtgtcggcgagggtctgattatcaaacatggagaaatttacaaaaaagtaccggaagcagaacttctgccggcactgcgttatgaattggaacattggagtgaagactgatgtcaaaagcatttcgtgaagcctttccgacactgaaactggaggaagaactcgaagggctgttagatacaactgaagtgacaaaaataagtgcgaatcatgaacatactcatattcgcatttatttgcgtgcaaaaagacttattttcaaaaaaaacatatggaaacttgaaaaagcgattaccgaacagatttttcagaaccgggccatacaggtaaagatcatagagtcttatgagctttccgaacagtataccccgaagtctctgatagaggtgtataaggacagtattttagatgaactgaatgcctacagtgtgctcgaatacaatctgttgcggacggcggacatggaatttccggaagaggaccgtctgattctgacgatggatgagactattattgccaaaacccgtacggatgagattatcgaatttttagagaaagtgatctgtgagcgctgtggaatgaatctgaaaatatttccacaataccggaaaccgcaggagagcaaataccggaaaaattccgaagaacagatccggcaggaagtggcaggaattgttgcgcggacgaagctggttatggaaggaaaatcccaggaaacggaagaaaaagagaaaactgtcgaaacagaagaaaaaacaaagacaattgcaaaaacggcaggaaatcgtgcagacacttcaaaaaatggtacaaattatgcaaaaccaaagcagaagtttgaaaagcggggagagttccgccggaaattcgagtcggataacggcaaaaaatccatgaatccggatgtaatatacggaagagacttcgaagaagagagcatggagattgagaagattgacggaccgatcggagaggttgtgatccgcggaaagattctgtcggtagatacccgtgagatccgcaatgaaaagaccatcattattttttccgtgacggattttaccgatacgattgttcttaaaatttttgcgagaaatgatgatgtaccggagctgttaaaagaaatcagcgggggaaagtttgtgcgtgtcaaaggtgttgcaaccattgataagttcgacagtgaacttaccatcggttctatcgtcggaatcaagaaatgcgccgattttacaacggtccgtatggataccagcgtagaaaaacgcgtagagctgcactgccataccaaaatgagtgatatggatggcgtttcagatgtcaaggatattgtcaagcgtgccatgaaatgggggcataaggcgattgccattaccgatcacggggatgtgcaggcgttcccggatgccaatcataccgtaccgtccgattcggattttaaagtcatttacggcgtggaggcatatctggtcgatgatttaaaggggatggtgacggacagccagaaccaggatctggatgcagattatgtggtatttgatttggagacaaccggatttagtccggagaccaatcgcattatagagatcggtgcggtgaaggtgcagaacggaaagatcgtggacaaattctcaacgtttgtcaatccacaagtgccgattccgtttcggattgagcagttgacgtcgatcaatgattccatggtgattgatgcacctgtcattgcagacattcttccggaatttatgaaattctgcgagggatgtgttatggttgcccataatgccgatttcgatatgagttttatcaagaaaaactgccagaggctggatattccatgcaagccgacgattgtggatacggttgccctggcgcgtgtcctgcttccgaatctgaaccgttttaagctggatacggttgcaaaagcgctgggcgtatccttggaaaatcaccatcgtgccgtggatgatgccggatgtacggcagagatttttgtgaagtttattgagatgctccgggagcgtggtatgtctaccttagacgaagtgaatgcaatgggaacctcatcggtgcagaatgtacaaaagatgccgacgtatcatgcgatcattcttgccacctgcgatcaggggcggacaaacctgtataagctgatttcgctggcgcatatcaaatattatcaccggcgtccgaggattccgaagagtgaatttatcaggtaccgggatggacttctgatcgggtctgcctgcgaagcgggagagttgtaccgggcaattttaaatggccgtccggaggaagaaatttctagactggtaaacttttatgattatctggaaatccagccgctcggaaacaatgcattccttgtaagagatgaagattctccggttgcgtccaatgacgatctgattgagatcaataaaaagattgtccggctcggtgaacagttccataagccggtggtggcaacctgtgatgtgcattttttagatccggaggatgaaatttaccggagaattatcatggcagggcagggatttaaagatgcggatgagcaggctcccctttttctgcggacgacggaagagatgctgaaagaatttgcctatcttggaagtgaaaaagcagaagaggttgttattacaaacacaaaccggattgcggatatgtgcgaaaaaatttctcccgttcgtccggataagtgtccgccggtcattgaaaattcggaccagatgctgcgtgacatctgttacaacaaagcacataaaatgtatggagatccactgccggaaattgtgcaggaacgtttagaccgggaattaaattccattatcagcaatgggtatgctgtgatgtatatcattgcgcagaagctggtttggaaatccaacgaagacggctacctggtcggatcgcgtggatcggtcggaagttctttcgttgcgacaatgtccggtattacggaggttaacccgctgcatgcgcattatctgtgcaaacattgccagtacagcgattttgattcggatctggtaaaatctttttccggccgaagcggatgtgatatgccggataagctctgtccgcgctgcggaaaaccgctttccaaagaagggtttgatattccgtttgagacgttcctgggatttaagggaaataaagagccggatatcgacctgaacttttccggagagtaccagagtaaggcacataaatacaccgaagttatcttcggggagggacagacctttaaggcaggaacgatcggtacgctggcggataagacggcattcggttatgtcaaaaattattatgaagagcgcggcgtacataagagaaattgtgaaattgaccggatcgtacttggatgtgtcggggtgcgtcgtactacgggacagcatccgggtggtatcgttgttcttccgatgggggaacagatttatacatttaccccggttcagcatccggcaaatgatatgacggtcgatattacgaccacacattttgattatcactcgattgaccataatcttttaaaacttgacattctcggacacgatgatcctaccatgatccgtatgctgcaggatctgacgggcgtagatccgacgcagatcccgctggatgataaggctgtcatgtcgctgtttcaggatacttccgcacttggcatcacgccggatgatctggtgaactgtcagctgggagcattgggtatcccggagtttggtacagactttgccatgggcatgttaatagacacacagccaaaagaattttcggatctggtgcgtattgcagggctgtcccatggtacggatgtatggcttggcaatgcacagacgctgattcaggaaaagaaagcaacgatttctaccgccatttgtacacgagatgatatcatgatctatctgatcagtatgggactggattccgaggaatcgtttaagattatggagaatgtccggaagggaattgtggcaaaaggaaaatgtgacaaatggccggaatggaagcaggatatgatcgatcacaatgtaccggactggtatatctggtcctgtgagaagattaagtacatgttcccgaaagcccatgcagccgcgtatgttatgatggcatggcgcattgcctactgtaaagtgttttatccgctggcttactatgcagcatatttttctatccgtgcgaccgcgttcagttatgagctgatgtgtcagggaaaagaaaaactggaaggatatatgcatgagtacgaaaagcgcaaggacgagctctccaaaaaagagcaggatacctacaaagatatgcgtctggtacaggaaatgtatgccagaggatttgaatttcttccgctggatatctataagtcagaaccgcatcattttcagattgtggatggaaaactgctgccggcgctcaatacaattgacggacttggcgataatgcggcagttgcgattgcagaagcggcaaaagacggaatttttctttccaaggatgattttagggaacggacaaaagtatcaaagacaacaatagaactgatgagtgatctgggattgtttggcgatatgccggaatccaatcagctttccctgttcgattttggcgcgtaatgttatggaagttttgaaaaacaaaagaggaggaaccgcatgtttgggttcctcctcttttacagtcttataaatttattttttgataacgccgggatggaaagcggtgagtgttcccggatgatcggtcggtgtacagaacatttcttttgtcttaaaatcggtaaaatagatgtaactggaagtgacgttgatattggagtaattgccctgtgccagttcctgatatccactgccgtcatttttgatcatacaaagggccggatggtcttcggaatagcgctgataaaaaatactgcttccgtatacattgtagagatccagactgtccttggtaagtgtaaccggatgaccggatttcatattggtatgtaccagggcgttgttctgatccacatccatataataaacattgtcgtcactggttacgatcggtttaaaagaattacattcgtagactttgcttaagctgtcactggcggtatccagctgatagatggcgccatcactttccgttccgctggtataaatatactgacccagcgtgctgcatgtaaaaatgtaaggcgaatatacttttttgcgtccttcgccatcgattccgatcttgtaaagcgttgtagcatccttgtcatcatagtgcagataataaatgtagtttccgacaagcgaggcatacaggcagggatctttgtctaaaattttagtgttttctccattctggtcaattctgcacagactgtttcttgcgtaggagaagaaatcaaatccggttccattattttcattattgcgtacatagtatacataatggtcatcggcgttgatatacatgacacggtcataactgagttttttcagatgattgccgtttgtatccatggaatacagccggtaatcgtcatccggattggcaaaataaacggttccgtttttctcacaaaacaagccggcattgtaaaggtttccggcagtatttccgttgacatagcttgtgttgtatttgatcttacttttctgatggctgtaaaagcccagtcctgcaaatactacgaccagaacagcaattataattatgggcaaacgttttttcataatatcgagtcctccttggtaagttgtatcttgccttttatacctttgtgttataaaattttatcataaatcatgaaggagcgctatatgaaagatttactagatatccgaaaagatattgataaaattgacgaacagatcgtaaaactctatgaggaacggatgaaactgacctcggatgtggctgaatacaaaataaacaccggcaagcaggtttttgacaaagagagggaggaatccaagctggcaacgctgcagaaaaaagcggaaagtgattttaccagacacggaatccgtgaactttttgagcagatcatggcgatgagccgtaagaaacagtataaactgctgacggagcatggaattatgcctccgcaggagtttgagccgattcacacgctggattattccaatgcaaggattgtttttcagggactcgaaggtgcctacagccagcttgccatggaacagttttttggagaaaactgcaataatttccatgtggagagctggaaagatgccatggaggccattaagaacggggaagcggattatgcggtactcccgatcgagaattcttcggcaggaattgtctcggaaaattatgatcttctggtggaatatgataattatattgtcggggagcagatcatccgtattgatcatgcacttttaggactggaagatgcagatgagagagatatccgtaccgtgtattcgcacaaacagtcactgatgcagtgcagtgaatttctggacagtcatgcggactgggaaaaattcagtgtcagcaataatgccgttgcagccaagaaggtcaaagaggatggggagatttcccaggcggcgattgccagtgcaaaaaatgcccagatttatgggttgaaagtattacgcaattccattcagaataataaaaataattcgacccggtttattgttgtgacagggaaaaaagtatataccgatcaggcagaccggatcagcatctgttttgagatcaatcacgaaagcggtgctttatatcatgcactgtcgcattttatttataatggactgaatatgacaaatatccagtcacgtccgttacagaataaaaactgggaatatcgtttctttgttgattttgagggaagatttgaggatcatgcagtgcagaatgcgctgcgcggacttcgggaggaaacaattgcattccggattcttggtacgtattagtcagaattggtgaaagaaggtgggcgtatggcaattcacacatttgcagcaatttatattggcacatacgatgtgagcctgaaggtatttgagtttacaaacagaaaaaagtttcatgaggtggatcacatccggtcccggcaggaactggggaaaggtgcttacggcaccgggacaatcggatatgagcaggtggaagaactctgtgaaacactggcgcagtttaaagagattatggaaagctacaaggtagacagttatgaagtctgtgccgcagccgcactccgggataccacgaatgagatatttgttctcgaccagatttatcttagaaccggattccgggtaaaggtgctcagcaattcggaacaccgttttatcagttataaagcggtggcgggaagtccggtgtttgaggagatgataaagacgagtgcagcagtcgtggatgtcggcggagcgagcgtacagattacgttattccgcaacggaaagatgatcacgacacagcacatggaagcgggcatcatgcgcctgcggaatctgcttggagaccgcggatattccctgaaaatgtatgaaaaccagattgaggaatatgtcaataaaaaactcgagggattccgtgccatgtatatgaatacgccggtggattatctgatcctgatcagtgactatgccggcggcttggtcaaaaaaattgaggaaaaaggcggaaaaagccggcaggtaaagctggataaattctctaaatttatcgataaactgctcaaaaaaacgctggaggagatcacagcggaattaaatctttcagatgagagggaaccgctgatcattccggcacttgtgctgtataaaatgatggcacagaatgtgaatccgaaagaggtatgggttccgggagcaaatattcaggatggtatggcatttgattatgcacagcacaacaaactgctggcgtccacgcatgattttgatgcagatgttctctcggcagctacgtttctgtcggaacattatcacagtttttccccgcatatccagacactttcgagactttccatcaagatttttgatgccatgaaacaggaacacggacttggaaagcgggcgcgtctgctgctgcaggtggctacgatcctgcatgactgcggaaaatatgtcagctttgcggaagcgtcggagagtacgtatcatattatcatgtcctcagagattatcggtctgacccatcaggagcgcgagattgttgcacagatcgtgcgctacaatactcttccgctggatccgtatgaggaagtcgctgatgtattgagccaggaagagtatctttgtgtggcaaaactttcggcaattcttcgtgtggcaaatgcgctggatcagagtcataaacagaagtttaaaaatatccggatcgcggtaagggagagaaaactcgtgattacggtcgaggcatttgaggatattgcgctggaacaggcattgtttgacgcaaagacctcttattttgaaaatgtatacagcatgaaacctgttttaaaagagaagcgtatttataactattagatcggagggcttttatggacacaaaaatagattttaaagatccggcatattatgaaaaccgtgaactcagctggattaagtttgaccagcgtgtattaagtgaagcaagagataaatccattccgcttttggagcggttgaaatttgtcagtattacttcttccaatctggatgaattttttatggtaagggtggcatccttaaaggatatggtacacgcaaaatataaaaagcgtgatatcgccggaatgaccgccacggagcagctttccgccatcaataaacaggcgcgggaactggtcaatatccagtacagtactttcagccgttccctgatgccgcttctgcgtaaagaaggaatttatcttctggatgcacatgaggatctgaacgaggaacaggcgcgttttgtggatcgctattttatggaaaatgtatatccggtactcaccccgatggcagtggatgcgtcgcgtccgtttccgctgattcgcaataagacactgaatattgcagcacttctgaccggaaagaaaacggaggatgagactgtgtttgcgaccgtgcaggtgccaagtgttctgccgcgtctggtacagattccaagcgaaggggaaacgaagtctttcattctgcttgagcagattatagaacgcaacataggcatactgttttccaattacaaggtattgtgtgcgtatccgtaccggatcatgcgaaacgcagatctgacgattgatgaggatgaggcatcagatttgctgaaagagattgagaacaaattaaagatgcgtcagtggggagaagttatccgtctggaaattgaagagaaggtagataaaaagcttctgaaatttttaaagacggagctgaaagtgtcggatgaggatatttttcagattgcaggtccgatcgatctgacttttctgatgaaaatgtatggcatcgacgggtacgatcatctccgctataaaccgtatacgccgcagcaggtgccggaaattacaccgggaagtgacatttttgccgcaatccgcaaaggggatatttttctgcatcatccatacgaaacctttgatccggttgtggatttcatccggcaggcatccaaagatccggatgtcctggcgattaaacagacactgtatcgtgtcagcggaaattccccgattatcagcagtctggcacaggcagcggaaaacggcaagcaggtgtcggttctggttgagctgaaagcccgttttgatgaggagcacaacattgtctgggcgaaaaaactggaacaggcaggctgtcatgtgatctatggtctcgttggccttaaaacacacagcaagatcgcactggtggtccgccgggaagaggacggaatccgccgctatgttcatctgggaaccggaaactataacgattcgacggcaaaattatatacggactgtggaatctttacctgcaaagagtcgatcggggaggatgccacagcggtatttaatatgttatccggatattccgaaccgctggcatggaatgaactggtgctggcaccatactggctgcgggataaatttttgcgcctgatcggcagggaaacaaaaaacgcgcagcagggaagagaagcccgtatcgtggcaaagatgaattctctctgtgatccgggcattattgcggcgctgtatgaggcatctgcaagcggtgtaaagattgatctgatcgtgcgcggaatctgctgtctgcgcgtcggaattccgggagtgagtgagaatatctccgtgcgttctattgtgggaaatttcctggagcacagccgtattttctatttttataatgacggcaatccggaagtatttatgggaagtgcggactggatgccgcgaaatcttgaccggcgtgtagagattgttttcccggtgattgaggaggaactcaaagaaaaagcactgcatattctgcatgtggaactggaagataatgtgaaagcgcgtgtgatgcagccggatggtacgtatgaaaaacttgacaagcggggcaaggttctgataaactcacaggagcagttttgtgcggaggcaaaagcagcagtgccggatcagaatccgggaaacaaccagcggctgtttattccggcagaaccggcggaataaatttacagaaaacagttgacaataccgtaatcaggtggtatagttaaatggttgttaagaaacaagtagagtatccactctcacctaagcgcaatcgggcgacttagtgttcatacttttagcatgttatatgaatgttagatgtaatagtggatagtctgcctatccactattttttattggaggtacaaaaccattagcgaattaatgattaacgaacagatcagagacagagaggttcgtctgatcggaccggatggcgagcagattggtgttgtctcatccagagaggcacagaaaattgcagatgaagccggtcttgaccttgtcaagattgctccgaatgcaaagccgcctgtatgcaaggtaattgattacggtaagtatcgttatgatcttgcacgtaaggaaaaggatgcaaagaagaagcagaagacagtggaattaaaagaaatccgcctgtcaccaaacattgacaccaatgatttgaacaccaagatgaacgctgcaaagaagttcctcgcaaaaggcaataaagtcaagatcacacttcgtttccgtggtcgcgagatggcacatatgaacagcagtaagcacatcttagatgatcttgctgagcagctttccgatattgcagtagtggaaaaagcaccgaagatcgagggaagaagcatcggtatggtgttggcagagaaaagataacatttattaaggaggaatacacaatgccaaaaattaagacaaacagagcagcagcaaagcgtttcaaagcaaccggaaccggaaagttaaagagaaacaaggcttacagaagacatatcttaacaaagaaaacaacaaagaataagagaaatctcagaaaagcagcaatgatggatcagacaaacatcaagaacatgaagaagattttaccatacatctaagatttgttaaggaggatataggaaatggcaagagttaaaggcggattaggcgctaagaaaagacataacagaactttaaagttagcaaagggatacagaggagctcgttccaagcagtatcgtgtagctaagcagtccgtaatgagagccttaacaagttcttattctggacgtaaagagagaaagagacagttccgtcagttatggattgctcgtatcaacgcagcagctcgtatgaacggactttcttacagccagttcatgcacggattaaaggtagctggagctgatttaaaccgtaaggtattagctgacatggctgttacagatgcagcaggttttgcaaagcttgcagaagttgcaaagaaagcattagcttagtcatcggaaaaatgttgggtagaaaactccggacaagttgtttgtccggagttttttgaaaaatatacggggaaaggtattggaaacaatggaaaaaagagaacagctcggaagcagacttgggtttattatgctctcggcaggatgtgcaatcggatgcggaaatgtatggaagtttccctggatgtgcggacaaaacggcggtggcagtttcatgcttgtctatgtgatctgtctgctcattttagggcttccggcaatggtgatggaactttccgtaggacgtgcggcacagacaagtcccttgtatatgtatgagaaactttccggaaaacgcaaatggaaaattccggggattgtgtgtctgattggaaatattgcactgatcgcgttttattccgttgttgcaggctggattatttattattttgtgaagtttcttaccggtcagaatgcggatttgggatttgaaaaaatgatcacaacaccatccgtaaatgttggttacctgttgatcacggttgtgattacatttgtgattttgagtttccggctgcagggaggccttgaacgcattaccaaatatatgatgtcggcgcttctggtgctgatgctggtgttggcgatccacagttttacgctttccggcgcaaaggatgggctggctttttatctgattccggacctttccaaaatatcaggtacaatgattgtaaaagcaatgaatcaggcgtttttcacgttgtcggtcggtatgggtggcatggcgatctttggaagctacatcgggaaagagcgttcccttttgggagaatccgtaaatatcattgttttagatacgtttgtagcagttgttgcaggcatgattatgtttcctgcctgcgatacctataatcttgaagtgactgcgggaccaagccttttgtttgatacgatggcgagtgtgtttaaccatatgcagggcggacgctggtggggtgcgctgtttttcctgttcatggtgtttgctgccatgtcaacggtatttggagtatgtgagaatctgcttgccatgatccgggaactgacgggctggtcacgtccggtgggatgtattgtctgcgggattgggacgtttcttgtggcattgccaacggcgctggggtacagtctgattcgttttcagccgtttgcaaaaggcacggcatggctggatttgtgggattttattgtgtctaacaatgcgatgccgctcggctcactgatactggcgctgttttgctgtacacgccggggatgggggtggaacaatttcctgcaggaggccaatgcgggaaaaggcttaaaaatcaaggcatggatgaaaccgctgttctgttattttgtgcctgtagggattttatttatttatatttatggaatgttcacgtttccgtggcattagaagaaaagaggggcaaaaattattctgtccctcttatttttatgcgataagctttgggagaggccccttttttcttatgaaaggtttttgaaaaatacagcccattatcaaatccgacggaatttgcaatggcggtgatcgaaagatttgagtgttccaacagatagcatgcctgtttcatgcgaaaatccgtgaggtattcttttggggactgctgcagcaccagttcaaaggaacggaacagatggctgcggcttaaaccgacgtaggcggcaatatcttccactgtgatcgggtaggagtaattggcgctgatatattcgatacttttctggacgtaggttgcggctgtcagctgcgtttctttttgggtggaagattttagaaagagcgccagcgtggtatagagccggccggtcatttcaacggcatgttcaaatccgtttcctctggcatcatagatatgcagaagctgacgtttgacttcttcgccgttgggaactgcatgaatacatggatgtttgcgggaaaaatcggttgcctgcagaattgtggcagcgtcacttccggtaaatccgacccatgcatattcccatggcgtttttgcatcggcacggtagatgatctccgtattcggatacacaagaaaggcatcttcggcagaaagaaaatgggtttcgttgttgacttcgtatgtgccttttcccgagatcacatagtgaatcaggtagtggtcgcggattccgggtccccactgatagccggcatcgcatagctggtatccgacattatagacagacagggaaacaagttcttttgcagttgctttgtaggaatttttatattgatcattcattggaaatgctccttacacgattctagtattgagtttatacgtttttttatgcacatgcaacatttttacatattttttctacatttggttctgtacattaagagccgggagcgatagaataggggtatcagaagaaaacaaaagcacagaaagggagagtggaattatggcaattttagttactggtggagcaggctatatcggaagtcatacctgtgtggaactgcagaatgcgggatatgatgtcgttgttctggataatctgtcaaacgcttcagaaaagtcactggatcgtgtggaggcactgaccggaaagaaagttacattttataaaggagatatccttgatcgtgacatcttaaataaaatttttgcagagcagaagattgaaagttgtattcattttgcaggactgaaggctgtcggagagtctgtggcaaagccttgggagtattacaataacaacattgcaggaactttaacactggttgatgttatgcgtcagaacggatgcaagaacatcattttctcttcatctgcaaccgtatacggcgatccggcagaaattccgattaccgagaactgcccgaagggacagtgtaccaatccttacggatggacaaagtccatgctggagcagattttatcagatatctacaaggcagataatgagtggaatgtgatcctgcttcgctacttcaatccaatcggagcacatccaagcggaaccatgggggagaatccaaacggcatcccgaacaacctgatgccttacattacacaggttgcagttggcaagttaaaagaacttggtgtattcggaaatgattatgatactccggatggaaccggtgtgcgcgattatatccacgttgttgatctggcaaacggacatgtaaaggcattaaagaagatcgaagagaacgccggactttgcatttacaaccttggtaccggacacggctacagcgtgcttgatatcgtaaagaattttgaggaagcaaacggcattaagattccatacagcatcaagcctcgccgtcctggcgatattgcaacctgttactgtgacccgggtaaggcagaacgtgaacttggctggaaagcgcagtacggaattaaggaaatgtgcgcagattcctggagatggcagaagaacaatccaaacggttatgaggattaatgaaaaaagagggaaaagtcttattttcggatttgtttgaatatttttgaaaaatatgaaaaatatgcttgacgaagcgtggggtgtatgctattataatacacggttcgttggtcaagcggttaagacgccgccctctcacggcggaaacacgggttcgattcccgtacggactgctaagttataaatccagtgtttatacagattcttgcgaagctgttgtaggcactggattttttgttttcttatgtggtcatatatgaaaccgaaacgtcgggttagaatgtcgaaacaagattacctatgagataatggggataaaagttatgcacttagtaaaattggaagagattcctggtgctaaagaagaattgaaaaaaattcgcaaacgattctacgattggatgaaagatccttctgcattttcagagtaattcacaaaatacccaagaaaccttgcaaaacagggcatttcttgtcagcaggaggtatattatgacatcaattcgtgttttattcgtatgccacggcagggctatggaaagtcagtaaaatcaaggatttagggggcattacttgggtatatcgtgtaaaatgaatatctaattggatatgaacatataatattaatgcagccataagctgcgatttgaacttattttgacattgacaagcggctcatttggatgtatattttaagtacagtaagagattactgcaaatgtttgttgctactcgatatgcaactcaaacaaggtcgagttcaaatgtttgtcgctactcgatatgcgacttagaaaaggtcgagttcaaatgttttgaggttccattcgagaggatggggcctctttttaacgataggagaagaaatggaaataggacatttttattatattgatgatcagtactttaaggattttccagatccttatttgatgcagaataaggaaaaagtaaatggacagttgcatgacagaccatgtttttacgcattccaggatagtaatactcagctattttggatgattccgttttcgtcacaggtttctaaatttaaggggatttataataagaaaatgcaaaagtaccataggtgcgatacaattgtttttggagaagtacttggtcatgagaaggcttttttgattcaaaatatgtgtccgattacagaaaaatatatgaaaaatgagtatttggactctgctgccaatataccagttcgtgttgatggtagattggaaaaggaattgaaggataaggcagggaaagcattagcgttgcagagaaagggcgcaaagctgatttttccagatgtccttagtatagaacaggaattattataatagatggaaatatctatgtcggataaagagaggtgctgtgccagttggcaggcatctttttctttataatccgcgtggtatatttcgcacatttttattgacaagagattgttgaggtggtgtttttataacataagagcgaaatatatcacataagagcgaaatatatcacataaaggcgatggcgattatgaatgaaaaagaaccaatgagcttgtcgaaaaaatataatatcagatacacaattgatggattagcgtggctgttatatgctgttgtcaatctgattccgggaaacggtattcctcttaaggtgttgtgcatcatattgctgttgattgcagtggtatgttcagtggtatctttggtggcaaaggcagaccaagaagatgagatgtccgatttgtatatcaacaaagctatggctgtttggattgtaatcatagatggtcattggattttttgcctgctacggctattaagaaaatgcgtatcagaatatttgagcaaggactatgtacaattgacatggctcgcgcatgggtgtacgaaatctatgcagatggaactgctataagattatgaatgagtatcccgaaggtgttattgtcgcagatgtccttgacggttgcggcgataatctacaggtgacctattctgataattggaaaagaatcatcaatggagaccttgccggaggaaaaaacggcacatgcaaacagtctattgcttgcaggaaaatcaaggctttagggggcactgacaattgcgtttgtaccctcattgtaccctccccccatttttgaaaagtgaccggactaccctcgataaatcctgctaagaatctgacctttttgacctgtttaggtgaaattagtcggatttttttaatatagtcattttgaaatttaatttagtcaaaacaacaaaaaacgactaaattaaaactattgacgacataattaaaaaagaatatcatgtatatagttaatttagttgtcaaagattgcacagtctggtctgaatggtcagtttagaactccaagacatatcatccgtatgatggtggaaatgatgaatccatcaagtgatgaagtaatctgtgatccggcttgtggtacatcaggattcctggttgctgccggcgagtatttgaaggcgaataagaaggatgagattttcttcgataagcagaaaaaagatcattatatgaatcacatgttttagggatatgacatggatagaagtattaaatcttgtgttcttcaaaaaggttatgagtaaggcaaaattctggcagatgattggacgtggaacacgactttgtcctggacttcttgatggtgaagataagcagaagttttatatatttgatttttgtggaaactttgagttctttagaatgaataaaggcaaagtaaccgcaaacatgattgcacttcagggagctatctttaatctaaagttcgaaatttcatataagcttcaggatattgattaccagattgatagattgattgcttaccgcaaggcgctagtgaagcagatgagtgagaaagtacaggaattaccgagggataattttgcagtccgacagcatttgaaatatgtggatttatacgcaacagaggcaaattatcaggtgctcacctacgaggatagcacaagcctggatagcagacagatttactttgtgaaccaaatcgtagaatacatagttcataatggaatgatgaaagatctctctgtcttgcaggagtcaccgtttacagatcagggaagtgtggtagagatatttactgatttgacggtgtggatgggaatcaggaaggttatagagtcgataaatgccaatgcggcagcgtaaaaaataattaacaaaggatttctaattattatgtcaaatgatacagaatttgatgctgttgtttcattttggtctgaacgtggaatgaatgtaagtagagtaccgcgctctaatatatcaaactcaaacctatagaaagtgcctgtatctgttgaagagaatgttgtcaactcttcatcagtaaaagtgacagaaaagataagtggtgtagataaaaatgagctctataccattataaactgtgttggaaaaaatgaaccatcatactagcaaataacatagtaggcgataagaagtctatgagtgctaaaatcacaaagcaatatccaaagaatggaacgcaacttaacaagatattcaagctattttataagacacttgcaaaaataaagaaataacaagaaagaggccagaacgataaaggatggcacgatatcgcttaagtcgaaggcaagttcttctaactctggcaatataaagataaaaatatgaaaaaagtatttgacaaagagtattgtgtatgatagtataatacacggttcgttggtcaagcggttaagacgccgccctctcacggcggaaacacgggttcgattcccgtacggactgttactattataaatataatagcccaacccgaaaaaatgttgtcgtatgacagcattttttttatttaatcataggaaattccttcctatgattaaataatgctccgcgagctgcgcatactcgcggaaataaagtttatgatggagaaacggcagcagaggctttgaaaaatgtggaagcagttatttccgaatagtagaaacggcaaaagctattgggcgaaatattcgtaaaaaattacttacagttctatcgtcagttctaccggacagtgatccgaaccgaacacatcggtatggatagctgctccggtgagactggaatctaaccgctttgaagtgatgaaataatcgatccgccatccggcgtttttctcgcgggctttaaagcggtaggaccaccaggaataaatgccctcggcatccggataaaaatagcggaaggtatccgtaaaaccggcgtttaaaagttcggtcatttttccccgttcttcatcggaaaaaccggcacttttgcggttggtctttggatttttcagatcgatctccgtgtgtgcaacatttaaatcgccgcagagaatgaccggctttttgctgtcgagctgaagaagataagcgcggaaagcatcttcccattccatgcggtagggaagccgcgccagttcgttctgggagtttggagtgtaacaggtgacaagatagaagctgtcatattcgagggtgatcacccggccttcggtatcgcagattgcggtgccgatgccgcgtgtgacctgaagaggttcgtgttttgcaaagattgccgtgccggagtagccttttttctcggcgtaattccagtactggtggtagcccggcagatcaagtgcgatctgtccttcctgcagcttggattcctgaatgcagaaaaaatcggcatctgcggcatgaaaataatcgagaaatcctttttgtacacaggcgcgcagcccgttaacgttccatgagataagtttcatttctgatgtcctcctgagttgcttttatacaaattatatacatatgggaaagaaagtacaagtcttgttactgcttgcaggggaacaataaccaggcttctgaaaaaagtacttgacgcatggcctgtgctatgatagtataatacacggttcgttggtcaagcggttaagacgccgccctctcacggcggaaacacgggttcgattcccgtacggactgctgaagttcttacctgattgggtaagaactttttgttttatgaaagaaatacacaaaatcccttgaaatcagggaaaaagagtgatatgataacaaaagtaacatagaaactaaggttgagagagggcagatgtcctctctcaaatttttgtgaaaatgtgttttatgtcaaagaaaagaggtggtaatatgtcaaaggcaagtacttatgaggcaaagacagaacaactgattcttccgattctggagcgtatgcagtttgaactggtagatgtagaatatgtcaaggaaggcagcacgtattatctgcgggcgtatattgacaaagagggcggcattacaatcaatgattgtgaagcggtggcacgtgagatgaatgaactgctcgaccgtgaagattttattccggattcctatacatttgaggtaagttctccgggacttggaagacctttaaagaaagaaaaagattatgtccgcaatatgggcaaagaaattgagatccgtacctaccgtgcaatcgaccgctgcaaggaattcacaggaattttaaaagcgtatgatgatacatctgtgacgattgcagatgagaacgacaaagagaccacctttttaaagacagatattgcactgatccgacaggcaattgatttttaggacaatgacttatagagcagtttatagaaaagcccgttttgcggaggtaaactgcgcaggagatatcgcttatgcgatacctcatatgtggaaaacacgataaatatatatggaggataaaaatcatgaataatgagttattggatgcgttaacgatactggagaaggagaaaaacatcagtaaagaaacgctgctggaggcaattgaaaattcccttttaactgcctgcaaaaatcactttggaaaggctgacaacgtaaaagttgtgattgatccggatacctgcgaatatcattgttatcaggaaaaaacagtggtagagaccgtggaagatccgattgagcagatctctttgcagaatgcccagatgatcaatggaaaatatacattgggcgatatcgttcaggtagaagtaaaatccaaggaatttggccgtattgcaacacagaatgccaagaacgtgatcttacagaagattcgtgaagaagaacgaaaagtgatttacgatgagtatttcagcatggaaaaagaagtcgtaacaggtgttgttcagcgttatgtcggacgcaatgtcagcattaatctgggaaaagcagatgcacttctgaccgaaagcgagcagatcaagggcgaaacattccagccgaccgaacgtatcaaagtgtatatcctggaagtaaaggctacttccaagggaccaaagattcttgtatcaagaacccatccggaactggtcaagagactgtttgagtccgaagtttccgaagtacgtgatggcattgttgagatcaaggcaatttcacgtgaggcaggaagccgtaccaagattgctgtatggtccaatgatccggatgttgatccggttggtgcctgtgtcggattaaacggtgcacgtgttaacgcgatcgtcaatgagctacgcggagagaaaatcgatattattacctgggatgagaatcctgccatcctgatccagaatgcattaagtcctgcaaaggtgatttccgttattgcagatgcggatgaaaaagcagcaaaggttgttgttccggactaccagttatcccttgcaatcggcaaagaaggacagaatgcccgtctggctgcccgtctgaccggattcaagatcgatatcaagagtgagacacaggcaagagagtccggggatttccttgattatgagaacgattatgaagacgatgaatatgacgataattatgagtatgatgaggaaggctattacaaagatccggatgcagcagaggagacttcttccgatgaagagccggcagaagaagcacctgtagaagaaacaccggtagaagaaacttcctctgaggagtaattatggcaaataaaaaaattccattgcgcaagtgtgtcgcctgtaatgaaatgaaagaaaagaaggaaatgatccgggtaatcaaaacaccggaaaatgaaattgtactggatgccaccggtcgcaaaaacggccgtggggcatacatctgtgcagatcctgagtgtcttcgcctggcgagaaaatccaaaggacttgagcgctcccttaagactgcaattccgcaggatgtgtatgaaagtctggaaaaggagatgagtacacttgcataatgatcccgtattatccatgattggaatagcagcaaagtctggaaatgttgtaagcggtgagttttctacagaaaaagcagtaaaaacaggtcatgcatatctcgtgattgtctctgcagaggcatccgggaacacaaaaaagagtttttgtaatatgacggatttttaccatgtgccatgctattgttacggaagtaaggaagcacttggacgctgcatcggaaaagaattccgtgcatcacttgccgtgacagatgaaaatctggcgaaggccgtagaaaagaagctcaaagagcacaccgtataaaaatataaaactgaataacggaggtaaattcatttatggcaaaaatgagagttcatgaactcgcgaaagagttaaatataaaatcacaggatattttagataaattaaaaaatacaaagtttgacggaaaaagtgcatccagcaatatggaagatgaagcacaggcactgatccgcggagcttttgcaaaagagacaaaatcggcagcagatgcaaaaaaaccggaagctgcaaagactggtgcaggaaaaccagcggatggaaaggaacgtccaaagaagaaatccagcatcacagccgtatttaatgcacagtacagcaaacagtccagaaagccggcaaacggaaataacaacaaccgtggaaacggaaatggaaacggtaataacagaagacgggaggacaataagcgtccggcacagcacagcatcattcgtccgcgtccggtcggggagcgtgctatgcgtccgatcagtgagcgtacgccttcgccgacagcggatcttgaagtaagtaagccggcaaacaataaaccggcagaaaacacaaatacccgcaacagccaggaaaaccgcggaaacaacaatcattccggtggcgagagaaacaacagaccgcagaatgacagaaacaatgacagaggcggggagagaaataataaccgtcatcagggagatagaaacaataacaatcgtccgaacggagacagaaacaacagccgtccacagaacgacagaaacaataacggcagaaagaaccgtttcagtaaagagccggcagcagttgcagcaccggaagaaatccgcggaaaggactcccgtggaaataatgaccgccgcaataacaacaataatcatcggaaagatcatgataaactcggcggaaagaaacaggaaaattatgtaaaccttgagaagcacggcggcagaaagaaaccacagcagcagccgaagccgaaggaagatgaaaatgtaatcaagacgatcacacttccggaaaagatgacaatccgtgatctggcagacaagatgaaactgcagccatctgctattgtaaaaaaactctttatgaagggtgaaatggtaacggtaaatcaggaagtagattttgagacagcggaagaaatcgcactggagtttaactttatctgcgagccggaggagaagattgatgtcatcgcggaactcttaaaagaggatgaagaagatccgaagaatctggttccacgtccaccggttgtctgtgttatgggtcatgtcgatcatggtaaaacatccctgctggatgcgatccgttccacacgtgtgacagaccgcgaggccggtggtattacccagcatatcggtgcatctgtggtgtccatcaatggacagaagatcacatttttggatactcctggtcatgaggcatttaccgcaatgcgtatgcgtggtgcaaattctaccgatattgcaatcctggttgtcgctgcagatgatggtgttatgccacagaccatcgaggcaatcaaccatgcaaaggctgccggtgtagaaatcatcgttgctgtcaacaagattgataagccgagtgcaaacattgaaaaagtaaagcaggagctttccgaatacgaactgattccggaagactggggtggaagtacgattttctgtccggtttctgcacatactaaggaaggtatcgacaatcttctggaaatgatccttctgactgcagaagtgatggaactgaaagcaaatccaaaccgtaatgcaagaggtctggtcattgaggcacagctggataagggacgtggtgcggtagcaacggttctggttcagaaaggaacacttcatgtcggagattccattgcctgtggaagcagctacggtaaagtccgtgccatgatcgacgacaagggacagcgcgtgaagaaggcaactccttccacaccggtagagatcctcggattaaacagtgtaccggcagccggagagacatttgttgtctgcgattccgataaggaagcaaaatcatttgcagatacttatatttcagaggaaaagaaccgcctgatcgaagataccaaggcaaagatgtcactggatgatctgttctcccagatccagtccggaaatatgaaggaacttgatattattgtaaaagcggatgtacagggttctgttgaggcagtgaaacagtcacttgtgaaactgtccaatgaagaagtggttgtaaaagtgatccatggtggtgtcggcgcaatcaacgaatctgatgttattcttgcttccgcatccaatgcgatcatcatcggatttaatgtccgtccggacccgattgcaaaagttaccgcagacaatgagggtgtagatatccgtctgtacaaggttatttacaatgcgatcgaggatgtagaggctgccatgaagggtatgcttgatcctgtatttgaggagaaagttatcggtcatgcagaaatccgtcagatctttaaggcatccggtgtcggtaatattgccggttcttatgtacttgacggtgtgatggaacgcggatgtaaagttcgtatttccagagaaggcgagcagatcttcgagggagatttagcatccctgaagcgtttcaaggatgatgtcaaggaagttaaggccggatatgaatgtggtcttgtatttgacggctttaatgacattcaggaacttgatcaggtagaagcttataagatggtagaagtaccaagataggatagaatatgagaaaaaacagtattaaaaatattcggatcaatgaggaagtgatgcgtgagctttccaatattatccgcggggaaatcaaagacccgcggatcaatccgatgaccagtgtagttgcagtggaggtcgctccggatctgaaaacggcaaaggcctatatcagtgtgctgggggatgaaaaatcacagcaggatacgattgcaggacttcgctccgcagaaggatttattcgcaggagcctggcaaagtccgtaaatctgcgcaacacaccggagatcaaatttgtattggaccagtccattgaatatggaatccatatgtcaaaaatgattgatgaagtgaccaaagatataaaggagaaaccggatgaagaggcttgatgagattcttgcagggaaaaaatcggtaggtcttgccggacatgtacgtccggatggggattgtgtgggctccacactcggagtttacaactatatccggaaatattatccggatgtggatgtgcgattgtatcttgagccgattcccaatatctttaaattcctgaatttttcatcggaaatccgcagtgactatgaggaatccgtggtgtttgatctgtttatcgccatggactgcggagatgagaaacgtctggggaatgctgcacgttattttcaggaagcaaagcatacagcctgtattgaccaccatgtcagtaaccagagttttgcagaggaaaattatattttcccggatgcaagttccacttgtgagctgatctgtgaactgttggatacggagaagatcacaaaagaaatcgcggaatgtctgtataccggaatggttaccgataccggagtgtttcagtattcctgcacgtcttcctccacgatgaatatggcgggcatgctgatggataaaggaattgatttcacaaaaattgtggatgaagcttttaatcagaaaacatacaaccagaaccgtgccatgggacaggcactgctttccagcagacttcgtctgggtggcagagtagtgacttcttttctgacgctcgaagagatgcatgcactcgaagttcttccgaaacatatggaaggaatcgtggagcagatgcgcaataccaaagatgtggaacttgcagtattcctttatgagaatgaggatcatacgtttaaagtaagttttcgtgtaaacggtgcgtttgatgcggcatcgcttgcgatgcattttggcggcggcgggcatgtcaaggctgccggatgtaccgtggaaggaccggcagaagaggcaatcgagcatattcttgccgaggttgagaagagattataatatgataaacggaattataaatgtttataaagagcggggctttacttcctttgacgtggtagcaaagctccgcggcattttacatgagcgtaaaatcggacataccggaacgctcgatccggaagcgaccggagtacttcccgtatgcatcggaaatgcaacaaaggtatgtgaacttttgacggataaggataaagtgtatcgtacggtgatgcatcttggcattacaaccgatacacaggatatgaccggaacggtgaaagaagatcgttccagagaggctgcattgctgaaagaacagaccgtggaagcggctattttgcagttcgttggagattatgagcagattccgccaatgtactcggcactcaaagtcaacggaaagaagttatgtgatctggcccgcgccggaatcgaggtagagcggaaagcccgcacggttaaaattttttccatagaaattgaaaaaatcaatcttccttatgtgacgatgcaggtgcactgttccaagggaacttatatccgtacgctgtgtgcggatatcggagaggtgcttggcgtaggcgcgtgtatggaatccctggtccggacaagagtgagtgtttttcctctggaagaggcacacacgttggcagaaattgaaaagataagggatgaaggaacgctggaagaactgattcttccggtggaccgcgtgtttgagggaaagacgaaactgacggttgtaccggaagcgtttcgttttcttcagaatggaaaccgtttaaacgatggaaattttacggatgttccggaaaaaattgcggatggtgagcaggtactggtttatgatccgatgggacatttttacgctgtatatcagtatgagagagaaacaaaggactataaagtccggaaaatgtttggtgcataaatatgatttgctggaataagatagaagattttcatatagaagaaccaacggcattgtcgctgggaaaatttgacggagtacaccgtggacacgaagcactgattgaacaccttctggaaaagaagaaagaagggttaaaggccgttgtttttacgtttgatattccaccgaaaaaacttacggagaataataattaccgtgtcctttcgaccaataaagaaaagcaggaaattctcaaagagcgtggaattgattacctgttggaatgtccgtttaccaaagaagtcatgtgcatggagccggaggcttttgttgcatggattgtaaaaagtctgcatgtaaagagcatggtagtcggatcggatttccggtttggccataaccggaaaggggatcatattctgctggaaaaattgtccgcgacatatggctatacccttagggtggtagacaagatccagtatgagggacgggacatcagcagtacgtttgtgcgggaacagatcataaaaggcaatatggaaaaggcaaatgatctgcttgggtatccgttttttgtaaagagtgaagtgattcatggaaggcagcttggaagaacgctcggaatcccgacgatcaatatggaacttgtggccgaaaaacttcttccgccgaaaggtgtatatgcaactgcggtagagattggtggaaaatattacacaggtgtgacaaatgtcggatgcaaaccgaccgtcaatcattccaataaagtaaatgtggagacgcatatattggatttttccggtgatctgtacggatatgaactaaaggtcagcttttattcttttatacgtccggaacagagattctcgtctgtagagatgttaaaagaacagatggaaagagacattgaaacgagccgcagtcgtatgatgtcgataaacggcgacatgtaaacatattacataaatattacaaaattatgttgacattgtaattatttgttgttatactcgttttgttatgagatttcatgagacatgagggaggaatctgtgaaatgaatcgtatgacaaaaaagagagttggaatggtacttgctttttctctgacactgaccggtgcggcagcctatatcgggatacagcaggaaaatacagataaaacagaggcggccggatcgctcacagccggtgtttccgcatctttgaatgcaagcgaagtggaggcgctggatgtgacggcaggagtaaccagtcagctgtatgataaaacagatgttgcggtggctgcgaatgaaaagcagatggttgcacagggaatcgaagatacgcagacaaaagaagcagtttcggaaaataccacggaggataccagcatctgtgggtataaaaatcttggaatcgcgcaggtgcagggaagcttaaatgtgcgaaaaaaggcatccacagacagtaaagttgttggaaaaatgactgataaagatgcctgtgagattgtctcggtcaagggagattgggcaaagatcacctccggcaaggtggaaggttatgtaaagacagagtatcttctgacaggagatgcggcaaaaaatgtagcaaagaaagaaattacaaaagttgttacagtaaataccacaacccttcgtgtaagagaaaaggcttctgaagattctgcaatactttctctggttggagagggagaggatcttgttgtggaagatacaaaagacggctggtataaagtggaagtggatgatcagaagggatgtatttccggagattatgtagaggtaacagaaaaacttccgacagcatcgacggtaaaagaactggaatacggagagggatacacggattcccgcgtttctttagtacagtttgcattacagtttgtaggaaaccgttatgtctggggtggaacaagcctgacaaacggaattgattgttccggatttacgatgcaggtatatgcgagatacggagtcggcctcccgcatcatgcggcaagtcagccggcatacggaaatcgaatcagtgcatctgaggcaaaaccgggagatctctttttctatggaagcggaagcagcatcagccatgtgggaatttatatcggaaacggtcagattgtgcatgccagcaatgcacgtaccggaattaaaatttccaatgcctattaccggacaccaatctgtgtcatatcgtatttaaattaaaaaactgtttacaacgatacggatttatgatacattagattagtatggtttaacccatattcggtgaatggacactccgaccttttgctgagtatcgggtgcaaaaatattttaaggaggatcataaaatgatcgcaaaagaaaagaaacaggcaattatcaatgagtatggaagaacaccaaacgacactggttcaccagaagttcaggtagctgttcttactgcaagaattcaggagcttactgagcacttaaagcagaatccaaaggatcatcattccagaagaggtatgcttaagatgatcggtcagagacgtggattattatcatacttaaagagcattgatattgaaagatatcgttctttaattgagcgtttaggactcagaaaataattgtaaacaaagagcggagttttatattccgctcttctttttgttgtatggcagaacttttttccgggaccactgaagaggacaaaacgctgttttgtattgttcagtagtttcggggttttgacataccgtattaaattttgaaggagagaatacatgtacaaaagttattcaatggaactggcaggcagaacactgaccgttgatatcggaagagtatgtgcacaggcaaatggtgccgcattattaaaatatggagagactaccgtattatctacggctactgcttccgacaagccgagagatggcgttgatttcttcccgctgagcgtggaatttgaagaaaaaatgtactcggttggaaaaattcctggcggatttaacaagcgtgaaggaaaagcatcagagaactctattcttaccgcacgtgtcattgaccgtccgatgagacctctgtttccaaaagattaccgcaatgatgtaaccttaaataatatggttatgtctgtagatccggagtgtcgtccggagctggttgccatgatcggtgcagcactttctactaccatttccgatattccgtttgacggtccatgtgccatgacccagatgggaatgaagaatggtgaatttattgtaaacccatcccagaaagactgggacgagggagatttaaagcttacggttgcatctacagcaacaaaggtcatcatgattgaggccggtgccaatgagattccggaagcaaagatgattgaggctatttataagtgccatgatgtcaaccagacagtcattgcatttatcaataagatccgggaagaggttggcaaaccgaagcatgcgtatacaagctgtgcgattccggaagaaatgtttgcagctatgcgggaaatcgtcactccggagcagatggaagaagcggtatttaccgatgaaaagcagcagagagaagagaatatccgtgaaatcacagataaatttgcagaggcttttgcagagaacgaggagtggcttgctgttcttgacgaggccgtttaccagtatcagaagaagactgttcgtaagatgatcttaaaggatcataagcgtccagacggacgtgcgatcgatcagatccgtccgctggctgcagaagtagatctgatccctcgtgtacatggttctgccatgtttacccgtggacagacacagatctgcgatgttgttacacttgcaccgctttcggaagtacagaagattgacggacttgatgagaacgtgacaaccaagcgttatatgcatcagtacaatttcccgtcctattctgttggagagacaaagccaagcagaggtccgggacgtcgtgagatcggacacggtgcgcttgcagagcgtgcattacttccggttcttccttctgtggaggagttcccgtatgcaatccgtgcagtttccgagacatttgaatccaatggatctacttccatggcatctacctgtgcgtcctgtatgtcactgatggctgcaggtgttccgattaaaaagatggttgcaggtatttcctgtggtcttgtgaccggagagacggatgatgattatctggtactgacagatatccagggacttgaagatttcttcggagatatggatttcaaggtaaccggtacacatgatggtatcactgcaatccagatggatatcaagatccatggcctgacccgtccaatcgtagaagaagccattgcccgtacccgtgaggcacgcgtctacattatggatgaagttatgagcaaggcaattgcagagccacgaaaagaagtaaatcagtgggcaccgaagattgaacagatcaccattgatccgaataaaattggagatgttgtgggacagaagggtaagacaatcaatgagatcattgcccgtacaggtgtcaagattgatattacagatgatggtgcggtttctgtctgtggaacagacaaggaggcaatcgcaaaggccattgatatgataaaaatcatcacaaccgattttaaggaaggacagatctttaccggtacagttgtaagtatcaaagagtttggtgcttttatcgagtttgcaccaggcaaggaaggaatggttcacatttcaaagattgccaaggaacgcattgagcatgtcgaggatgtactgacgcttggagatgttgtgaaagttgtctgtcttggaaaggacaagatgggaagaatcagtttttccattaaggacgttccggcagatcagaaataaaataccgtacagaattaagatccatgaaagatgtacttcaggggccgcaccatgcggcccttttttcataccatgaaagaaaaaggcgatgattcgaaaagttcggagttgaaatatgaatcgtgtcaaacagcttgtacatgcagagaatgtatatcgtatgggttacacggggaaaaatatccgggtggtgacactggacacaggcgtttatctacatccggatctgcggcagaatgtggttggatttctggattttgtggcaatgaaacgagcctgttatgatgataatggacacggaacacatgttggcggaattttgtgtgcgaatggcagaatgaaaggaatggcaccgcaggcacagctgattgcgctgaaagtcctcgggaaggatggaggaggacagacggagcgggtgattcgtggcctgcaatgggtgcttgcacatcgtaaagaactgggaatccggattctgaatttttccgtaggatttcttccgggggcactcgaccgtgagcagaagcagattatggaacttttagaacagctgtgggatgatggcgtgacggttgtcacagcggccggaaataatggcccgggagccgggacagtcacggctcccggtatttcgagaaaagtgattacggtgggggcaagtgatgaccggagttctcctggggaaaggcgtggtggctacagtggcagtggtccgaccggatgctgtattatgaagccggaaattttagcaccggggacgaatattgtaagtctggatcatcacggagcactatattccagaaaaagtggcacctctatggcaacccctgtcgtatgcggggcactggcacttgcattacagaaaaatccaaagctgcggccggaagaactgaaactgaaattatatgaatcggcgcggaaagaaacgggaatgtccatggcgtggggcgttcttgatgttgataatttgctggcattggtataaaatactctctaaaagcctgtcggtgacattttatgagaaccaaaggaggagacagatgaaacgaatattaaataaactcttcagtaaacttgttcttggaggattgattattatattgcagttcagctggtttgtctatctgttgtacagtgcgaccgtatacagttccatggtagatgcattgtttaaaattgcatccattgtgcttgcattgtttgtctccagcagggatatgcgttccacatataaaacttcctggatttttctgatactggcacttcctctgttcggaattccggcatactatctgtttggccgtccgggactgacaaaacggacccgtatgaagatggacgtggtcagcagcaggatacgggcatacagttctccttccgatgatgtgatgtctgctttaagggcagaggatgattctgccggacagcaggcgcagtatcttgcccgttatgcggggtatccggtgtacagggaggcggatacacagtattattgttgcggagaagagatgtatccgcagtttctggaagatttaaaagcggcaaaatcttatatctttctggagtattttattgcggaacccggcaagatgctggatgcaattgttgaaattctggctcagaaagcaaaagagggcgtggatgtacggtttatgtacgatggaatcggatgtatccagacactgccgaataaatattattgttatctgcaggaaaagggaatcaaatgtgcctgtttccagccatttcgcccactgatgtcaattatccagaataaccgggatcaccggaagatcacggtgattgacggaaaggttgcctataccgggggaatgaacctggcggatgagtatatcaatgccagagtgcgttttgggtattggaaggatgcggcaatccgtctgaccggagaatgtgtctggagttttacaagcatgttcttggaactgtgggattatattttgaaaatagaaagtgattatacattttatcgggcaacttccatggaaaaacacaggttgcaggaaaaaatccatgcagatgaaaaaggattcgtccagccgtataccgattctccactggatcacgaagatgtcggcgaaaatgtatatctgaatatcatcagcagggcaaaaaaatatctttacatctttactccgtatctgatcatcggatccgagatgcgtacggcacttgtaaatgcggcaaaatccggcgtggatgtgcgtctggttgtaccgggaattccagataagaaactggtgtatttcctgacacagtcgaatttcccgtatctgatcaaaaacggagtgaaaatatacacatatacgccaggttttatccatgcaaaatgttttgtgtcggatgatgtacaggcaaccgtgggaacggtaaacatggattaccgcagtctgtgtctgcattttgaatgtggcgtctggatgtatcgtacccgggcagttttgcaggtaaaagaagatgcgttaaaaacatttgcggaaagccacgaagtgaccctggaggaatttcaaagaaaatcgtttcttgtgcgtacatttatgggagcattgaaattgtttgcccctcttctgtaaaacactaaatatagtaaattgtccttgcattttctacaacataaagataaaatatagattatgacagaaaggacgagagggatggaactgaccgttaaactccaggtatttgagggaccgctggatctgcttttgtatctgctcgaaaagaataaagtgaatatctatgatattccgattgtggagatcacggaacagtatatggagtatatccgggaaatgaaacggcaggatctggaggtgctcagtgagtttctggttatggctgcaacactggtcgatatcaaatcacgcatgcttctcccgtcgaatccggacagtgaagaggaagaagaagatccgcgtgcggaactggtacagcagcttctggaatacaagatgtacaaatgtatggcgtatgaactaaaagaccggcagatggatgccggtcgtgttatgtataagaagccgacgattccggaggaagtgcgtgcgtatgaaccgccggttgatatccacgaactgatatcggacattacgctttcacgcctgcatgaaatttttgagagcattatgaaaaaacagcaggataaaattgatcctctgcggtcaaaattcggaaagattgaaaaagaagaggtatcgctggaagacaagatggaggatttgaaaaaatatgcggccggacacagacatttcagtttccggggacttttgacggcacagtcatcgaaagtggaagtgatcgttacgtttcttgcgattctggagctgatgaaaatgggaacgatacggatttcgcaggaacatatttttgatgatatccagattgattcgaaagttgcagcatagattatcatgtattgcaggatggacggaaaatatggaagaaaaaaaatacaaggcaattatagaaggaattctgttttctatgggagaatccgtagaactggaaaaaattgcaggaactcttggacttgatcagaagaaaacaaaggaactgatcgatgaaatgagaaacgagtgggaagaacagaaacgcggcgttaccatcacggagctggatggagcctaccagatgtgcaccagacccgaaatttacgaatatctgattaaaattgcaaagcagcccaaacgccgggttttaaccgatgttcttttggagacgctttccattattgcatataagcagccggtgacaaagatggaaatagaaaaaatacgtggcgtgtcatcggatcatgcggtaaacaaactggtggaatatcatctggtgtgtgaacttggaagacttgatgcaccggggcgtccgttacttttcggaacaacagaagaatttttacgcagtttcggcgtacattcaatcgatgatctgccggtactcagtccggtacaggtggaagagtttaagcaggaagcagaagaagagatgcatgtgaaattggacgtataaaagaagcaggaataatcatatacatagaataaaaatgtatatggttatttttttatgtttcaaaaaagaatctgcacaaaaatagtaagtctgttgctggtaatcggatgtctgatgagcgaaccggttttggcagaaaagcaaaaagaacccgaagcgcagacactgtattcaaaatcctgcgccatggtggatggtgacagtgggcgccttttgtatggaaaagaggcacagacagcactgccgaatgcaagtaccacaaaaattctgacctgtatcgtggcgatggaacaatgtaagcccgatgaagtggtcacattcagcgcaaaagcggcatcacagccgaaggtacatctcggggcgaaaaaaggagaacagttctatatgcaggatctgtggtatgggctgatgctggaatcctataatgactgtgcatatgcaatcgcagaacatgtggcgggatctgcggaaaaatttgcagcacttatgaatgaaaaagcaaagaagatcgggtgcaccgacagccattttgtgacaccgaacggtctggatgcaaaggatgagcagggggaacaccataccacagcatatgatctgtgcaggattatgagttattgcgcatggaagtctccggtaagcaagcagtttctggaagtgacgcagacccggtcatatacatttcagagcctggagggaaccggatatgctgtttccaataaaaatgccctgctggatatgatggatcatgtgattaccggaaaaaccggatatacgtccaaagccggatattgctatgtggctgcacttgaagaaggggggagacattatgcaatcgcacttcttgcctgcggctggccgaaccacaaaaattataagtggtccgatgcaaagacactgtttcaatacggaatggatgcctatcatctgtatcggggatcggaagcatccatggagctgccggatatagagattgcgcagggctgtcggaaagaaacactcgaggaatgggctacccatgccaaactgccggtttatgttgatacggatatcacaaaactgacgtttttgaaaaaagacggggataccgctgaaataaagaaagtatggtctgatccgataagccttccggtcaaaaaagggcagacgcttggacgtgtttcctactgtatgaacggcagggaaatttactccggaaaaattaaagcagaggtttccgtaaaaaaatggtctcctgaaaagttttttcaaattatgtggaaagaggcactgttgggcaaataggaaattagtcacaaagaattagtgaaaaaattaacaaattatgttgaaaagaattgggaaatgagatacaatacaaactagcggaaatttttattttttatagatggagggcataaaatgagtagtaacaatgaaaacttggcaattcagcgtattgctaagttggtcgatgagaacagttttatggaaatcggttctctcgtaacagcacgtagcacagattttaatcttaccgctgcaaagaccccttcagatggcgttgtaatcggtcatggactgatcgacggcaatctggtatttatttacagccaggatgcatccgtattaaacggtaccatcggagagatgcacgcaaagaagattgcgtctgtgtatgacatggcaatgaagatgggagctcctgtcatcggtctgattgactgtggcggcattcgtcttcaggagtcggttgatgcattggatgggtttggaactatttatgcgaaggaagtagcagcttccggtcttgtacctcagatttgtggtgtatttggcaattgtggcggcggcctttccgttgtcccggcactttgcgatttcgcgttcattgaagagaagaaaggacgcatgtttgtaaatgctccggatgcaatcgaaggcaataacacagaaaaatgtgatacagccagcgcagcattccagagtgaaaacaacggatgtgtggatttcgttggttcagaagatgaaatcatggagcagattcgccagcttgtatgtatgcttccaagcaacaatgagggagatgtctatacagatgactgtgaagatgatttaaatcgtgcctgcgagagtatggagaatatgaagggagatccgagatatctgttatcccagatttcagataataacgtattcttcgagacaaaggcagattatgctaggaatatggtaaccggactgatcaagttaaacggaatgacagtcggtgctgtggcaaactgcagcgaagtatatgatgcagaaggcaagaaagcagagagctttgacaagtccctgaccgcgcagggatgcaacaaggcagctgaatttgttcagttctgtgatgcattctcaatcccggtacttaccattacaaatgtgaatggattgaaaaactgcatgtgctctgagaagaaacttgcaaaggcacttgcgagaatgacttacgcattttccaatgcaacctgtgcaaaggtaaacctgatcacaggagaggcttacggaagtgcttatgtatttatgaattccaagtctgtcggagcagatcttgtatacgcatggagcggagcaaagatcggtgcgatggattctactctggctgcaaagattatgtatccggaagctggtgcagatgagatcaagcagaaagctgctgattatgaaaaacttcaggattctgccgcatctgctgctgcaagaggatatgtggatcgtctgattgatccggcagataccagaaaataccttgtagctgcttttgaaatgctttatacaaagtatgtaagcgagccagaaaagaaacacggtaccaagtagaaaggtgaagttttatgaaaaagagaattgcttttgcactttgcatgatcctgatggttctgatgcttggtgcatgtggaacagacccgactaccgtggattacaatggaaagtcctattcagatcttcagtctgaaatggataccaatgcgggcatggtacagagtctggctcagttgttcaaagaaaacaaactgacagcagatactcttccggacgatgtaaaggatcagcttacttcaagctacggtgtcacagaggcacagattgaggcagctgcaaagtggcaggatactttggatgagtttggtaaaatgaaaaagatcgaagacgatacttttaaggttaccaaatccggtaagacacttaccacagatatgaccatcaagttcgcgaagaaagatgtgaatttcgaagtagtatatgattactattccatggatgttaccggcatttcggtagatccgatttatacactcggtgagaaaatggaaaaggcaggactgaatactgtaatttctatggcagttgtatttgctgtattgattctgatcagtcttcttatttcctgctttaagatcttcccttatctggagaaaaagaaagctgccaaagcagccggacaggctccacagcaggaagagacaccagccgcagcaccggcacctgcccctgttgcagcacagacagatgatactgaacttatcgcagttattgcagctgcaatcgctgcaagtaccggaacttctaccagtgatttcgtagttcgttccatcaatcgtagataggatagaaagaaaatttaggaggaacatattcatgaagaattatacaattaccgtaaatggtaacgtttatgatgttacagtagaagagaccggaagcacatccggcgcagcagcaccgagacgtacagctgcaaagccagctgcagcaccagcagcaccagctgcttcagcaggagccggaagcattaagattgaagcaggagctgccggaaaggtattcaagattgagaagaaagtcggcgatgctgtaaagaagggagatgccgtcctggttcttgagatcatgaagatggagacaccagtcgttgctccggaagacggaactgttgcaagtatcgatgtagcagttggtgatgccgtagaatctggtgcattactcgctacattaaactaatccaaggaggaaaacactgtgagttatgtaggtgaaacattatcgaacctcctgcatcagacagcctttttcaatctgacctggggaaattatgttatgattttagtggcatttattttcctgtatcttgcgattaagaaaggttttgagccattactgttagttccgattgcatttggtatgcttctggtaaatatttacccggatatcatcgcaagcccggaacagaccagcaacggcgtgggcggtttactttattacttttacacattggatgagtggtctattttaccatctctgatctttatgggtgtaggtgcaatgacagactttggtccgctgattgcaaacccggtcagtttccttatgggagctgccgcacagtttggtatcttcagcgcatacttccttgcaattatacttggatttaatgacaaggctgccgctgccgtatctatcatcggtggagcggatggacctacttccattttcctggctggtaagttgggacagaccggtctgatgggaccgatcgccgtggctgcatattcctatatggcacttgtgccgatcattcagccacctatcatgaagttatttacaacaaagaaggaacgtgcgatcaagatgcagaaccttcgtccggtcagcaagctggagaagatcctctttccaatcgttgttaccgttgttgtctgcgtactgcttcctaccacagcaccacttgttggtatgctgatgcttggaaacctcttccgtgagtctggcgttgttcgtcagctgcaggagactgcaagtaacgcacttatgtacattgtcgttatcttactgggtacctctgttggtgcaactaccagtgcagaagctttcttaaatgcaagcaccttaaagatcgttgtattaggtcttgttgcatttatggttggtactgctgccggagttttatttggtaagttattatgctggattaccaagggcaagattaaccctctgattggttctgccggtgtatctgccgtgcctatggcagcccgtgtatcccagaaggttggtgcagaggaggaccctacaaacttcctgctcatgcatgcaatgggaccaaacgttgccggtgttatcggtactgcggtagctgcgggatgtttcatggctatatttggaatttaataaggaggaaaagtcatgtcagaagtggtaaaaaaaccattaaaaataacagaaactgttttgcgtgatgcccatcagtcactgatcgctacacgtatgacaacagagcagatgcttccgattatcccaaagatggataaggttggattcaatgctgtagagtgctggggtggtgcgacattcgatgcctgcctgagattcttaaaagaggacccatgggatcgtcttcgtaaattaagagacggatttaaaaatacaaaactgcagatgctgttccgtggacagaatatcttaggatatcgtccgtatgcagatgatgtggtagagtattttgtacagaagtcaattgcaaacggaattgacatcatccgtatttttgactgcttaaatgatatccgtaacctgcagacagcagttactgcatgtaacaaggaaaaaggtcatgcacaggtagctctttcttacacccttggagatgcttatactctggattactggatggagatggcaaagcgtgtagaggatatgggagctgattctctctgtatcaaggatatggccggtcttttagttcctgctaaggctacagaacttgtacaggcactgaaggattctacctctcttccggtagaacttcatacacattatacttccggtgtagcttccatgacatatatgaaggcagtagaggctggtgtagatatcattgatactgcaatgtctccatttgctcttggaaccagccagcctgcaacagaggttatggtagaggctttcaaggacacaccatacgataccggtcttgatctgaatctgttaagtgagatcgcagattacttccgtccgttacgtgaagaggcacttgcaagcggtctgatgaacccgaaggtacttggtgtaaacatcaacactcttcgttatcaggtaccgggtggtatgctttccaacctgatttcccagctcaaggagcagggaaaagaggacaagtacgaggaagtgcttgcagaggttccgcgtgtgcgtaaagaccttggtgagccaccgcttgttactccgtcttcccagatcgttggtacacaggctgtatttaacgtattgatgggagagcgttataaagtcgcaacaaaggagacaaaggatattcttcttggtaagtacggccagaccgttaaaccattcaatccggaagttgttgacaaggttctcggagaggataaaaagaatgcaatcacctgtcgtccggcagatcttcttgagccggagcttggtaagattgaagctgagatgaaacagtacaagcagcaggatgaggatgtattatcctatgcattgttcccacaggttgctactgatttcttcaaataccgtgaggcacagcagactggtgtagacgcaaagactgctgatacaaagaacggagcatatccggtatagtcatatccggtttctacgaaaaagacgcatcagatctggtgcgtcttttttgatgggaaaaattctttttgcatgaaatcttgcattttccggttaaagtgatacaatcaaaagtgctgtttgtggcacagcttttatgggataaagaggagaatatgatgtcaaataccaatgatctgttaaaccggattaataattgttacagttcgatgagcaagggacagaaaatgcttgcaacttacattacagataattatgataaagcggtatttttaacagccgccaaaatgggggaaacggttggtgtcagtgagtcgaccgttgtacgtttcgcaacatatcttggatataaaggatatccggaatttcagcgtgccttagaagaactggtgcgcaataaattaaattccgtacagcgcatggaggtaacctacggaagaatcagtcagtcgaagattttagagacagttttatcggcagacgcggacaagattaaaacgacactggaaaaaattgatcacagtgcgtttgaggtggccgtctcgacaatccttgaggcaaaaaatatttatattgtcgggatcagaagctgtgcgccgcttgcaagttttctcggattttatctgaatctgatgtttgataatgtgcgtctgcttacgacaaacagttcgagtgaactgtttgaacagatggtaagaatcggggaaaatgatgttattatcggaatcagtttcccacgatattccatgcggacattaaaggcattggaatttgcaaataaccggagtgcaaaagtaattacaattactgacagcatacattcaccgatgaatctgtattcttcctgcaatctcattgcggacagtgatatggcatccattgtggattcccttgtcgcaccgctttccgttatcaatgcgctggtagtggctctgtgcatgaagaaacagaaagaagtggcgggaacactgacgatgttagaagacatctgggatgagtatcaggtatatgaaaacgatgagattaattatattgatgattcgattaaggttcattatgcaaaattaggggatatcgataatgagtaaagtaatcgtgatcggtggaggaccggcgggaatgatggctgcgtatgcggcagcggagagcggacatgcagtgacgcttttagaacagaatgaaaaactcggaaaaaagctgtttattacgggaaaagggcgctgcaatctgacgaatgccagtgatatggaacagctgtttgccaatgtagtcagcaaccgtaaatttttatacagtgctttttactcctatgacaatgagcaggtgatttctttttttgagagtcatggaatgcctacaaaaacagagcgtgggaaccgggtatttcccgtgtcggatcattcttccgatgtgattgcggcgttatccaccgcattgcgggggcagcatgtggaagttttcttgcatacaaaagtaaagcgtctgctgcttgaaaagagggatgaagaaaagcgtgttaccggtgttgagctggctgatcatacaaaaatgcatgcggacgcagtgattgttgcaaccggaggaatttcctatccttcaacaggggcaacgggggacggttaccgcatggcagaagagagcggacataagatggtatcgccgactccggcactggttccgatggaaatgaaagaaccgtgggtcagggatctgcagggcctttcgctgcgcaatgtccgtatgtcggttacccggggaaagaaaaaactgtatgaggattttggagagatgctttttacgcatttcggcgtcagcggtccgctggtattgtcggcaagcggatgtatcccggcaaaagcatttgaccaggagctttccatgacgattgatctgaaaccggcactggatgtggaacagcttgatcaccggatcttaagggaatttgatgaaatgaaaaataagcagtttaaaaattctcttgggcatttgctcccggcaaaaatgatacccgttatgattgcgttatcaggcattgatccggatacaaaggtgaatgaaatatccagggaacagagacagaatctgttacatctgtttaaaaatatgccgcttacaattacagggcttcgcgattttaaagaggcaattataacaaagggcggtgtttccgtgaaagatatcaatccttccacgatggagtcaaaacttgtgcaggggctgtatttctgcggcgaggtgctggatctggatgcacttaccggtggctataatcttcagattgcctggtccaccggacacctggcgggaatatccgttttgtaatttcaaagataaataatttatttcaaaggagaatagaaaatggcatttaatattgcaattgatggaccggcaggagccggaaaaagtacaatcgccaaaaaacttgcggcggatctggggtatgtgtatgtggataccggtgcaatgtaccgcgcgatggcatattattttttacagaatcatatcgatgcttccgatgagcaggcgattgcggctgcctgcccgaaggtagacgtgaccattcagtatacgggcggagaacagcaggtgatcttaaacaaagagaacgtaaacggcgttatccggaaagaggaagtcggcaacatggccagcgcgaccagtgtttatccagtggttcgtacaaaactggtagaattgcagagacagcttgccgcaaaggaaaatgtgattatggatggaagagatatcggtacggttgtccttccggatgccaatgtgaaaatttatctcactgcaagctcgaaagtgcgggcaaagcgccgctttgatgagctgacagcaaaaggtgtatcctgtgatatggatgcgatagaaaaagatattattgagcgcgattaccgggatatgcaccgggaaacttccccgttaaaacaggcggatgatgctgtccttttagactcatcggatctggatattgacggcgttgttgaagaaatgaaaaaaataatcaagaaggcggaatagacaaaaatgaagctgacgattgcaaaaagtgccgggtattgcttcggcgtgaaacgggcagtaaatatggtatatcaggaagcagaagaggcaaaagttccggtatacacgtatgggccgatcattcacaatgaagaagtagtcagggaccttaaacagcgtggagttcatgtggtcagggagctcaaagaacttgagaatcttccaaaaggaaagattatcatccgttcacacggtatcagccgcagagaacatgaagcaatgaaggcatgcggatttgaagtgctggatgcaacctgtccgtttgtcctgaaaattcaccggcttgtggagaagtacagcaaagaagggtaccggattgtgattgccggaaacgaacatcacccggaagtggaaggaattctcggatgggtggaaggacagcctgcctatacggtcacaagtcaggaagatattgaaaaattaccgttaaaagagggagaaaaagtctgtctggtggcacagacgacatttaactacaataaatttcaagaattagttgaaattataaagaaaaaaggttatgatataagtgttttagatacaatctgcaatgcaacggaggaaagacagacggaagcacgcaaaattgctgcggagtcggatctcatgattgtcattggtgacaagcatagctccaatacgcaaaaattgtatgaaatatctaaaaaggaatgtgcaaatacttactatatacaaacgagtaaagatatggattatcatcagatacaatccatcaataacgtaggtattaccgcaggggcttcaaccccaaacaatatcatcgaggaggtttcaaagaatgtcagaaatgagctttgaacaaatgttggaagaatctttaaaaacaataagaaatggagaagtggtagagggtaccgttattgatgttaagccagatgaaatcatcctgaatatcggctacaaatcagatggaatcattacacgtaatgaatatacaaacgagccaaatgtagaccttactacagtcgtaaaagccggcgataccttagaagccaaagttgtaaaagtaaacgatggtgagggacaggttctcctttcttacaagcgtctcgcagcagagaagggaaacaagagattagaggaagcattcgaaaatcaggaaattttaaaggcaaaagtcagccaggtacttaccggtggtgtatgtgtcaatgtagatgagacaagagtatttatcccggcaagccttgtatctgacacatatgagaaagacttaagcaagttcaaggatcaggaaatcgagtttgttatcacagagtttgatcctagaaagagaagaatcattggtaaccgcaagactttattacttgcaaagaaggcagagcttcagaaagaactgtttgcaaagatcaaagtcggcgatgtaatcgaaggaactgtaaagaatgttacagatttcggtgcattcatcgacctgggcggagtagacggattacttcatatctcagagatgtcatggggcagagttgagaatcctaagaaagtatttactgttggacagaaagttcgcgtatttatcaagaatattacagataccaagattgcactcagcatgaaatttgaggatgagaatccttggaatggtgctgcagagaagtatgccgttggcaacgtggtaaaaggaaaagttgcacgtatgacagatttcggtgcattcgtagagcttgctcctggtgttgatgcattacttcacgtatcacagatctcccaggaacacgtagagaagccttctgatgtattaaagattggtcaggaagttgaagcaaagatcgtagacttcaacgaagaagaaaagaagatcagcttaagcattaaggctcttgcagctccggctgaagatgctgagacagaggaataattcactgtaaattttcataggtaagaagttgccttcgggcagcttcttattgtttatagggggtaaaagtctatgtttgacaattatgaaaaattcaaaaaagacgtctatgctctgacaaaaatcgatctgaattattacaaagaaaaacagatgcgcagacgaattgatacgattgcgacaaagcatggctgcagcaattatgatgagtatattcgtgtgctgaagacagacaaggacaaatttgaggcatttgtcaattttcttacaatcaatgtctctgagttttaccgtaatccggatcagtggaagctgatggatgagaatgttattccgaaacttatcaaacagcatggaaaaaatctgcatgtgtggagtgcagcctgttcgacaggagatgaaccgtattctcttgtcatggcattatccaaacatattccgctttccaacattcatattacggcaaccgatctggacaagcaggttcttcagaaagcgcaggttggtctgtacaatgaaaagagcattgcaaatgtgccgccggaatttaaacgcaagtattttaaacagatcggaaaatcatttcagatttcggatgaaatcaagcgctgcgtgacgtttaaagaacacaatctgttaaaagatccgtatccaagggattttgatatgattctctgcagaaatgtggttatctattttacagatgatgcgaaagatatgatttatcaaaaattccatcagtcactgaagagtcatggggttttatttatcggaagtacagaacagattaccaattataaagaacttggatttgacagactcagcagtttttattttgaaaagaatgtttaaaccaataaaaatgcatgtttttatgcctgaaacataagaacatgcatttttgcagtcttaaattattatttttttcccatcatattttttaagatgtgatcaatatagcggcgcaacatgatatcagaggtacaaaaatcatccgtcatctcaaaataactgattttatccttatactctttacggaactccggttgcataacactgttgtattgcggaagaaatttgccggatttgcgcgtataacagttgcttgctttggcattttcccggtattctttgtctacaaatgaggcgacacttttgtgtattgccatatcttcttttttcagataatagtaatccctgtaattggaataaaaataatgcagttcaccttcgtagaccggaatacgaagagaagtgcggttttttccgatcatcagataaaaacaatcctgtttacaggaaagctggcgcggaacaggatagtcgttttgcatggtgatgatccattcctccccttcggttccgtcatatgcgtggtaatggtcgatccggtgggagaggatggtgtactgaccgtttaatacttccagataagataaaacagagagcagatcaatcatgtgcagaacatcttcgtaattatgaatacgaagaagatgcatcgtttcttctgtcggatgtttcacatgcgtgaaatatacatggatcagatcccctcccgtcttttcgtcttctcttttaagacccagaaaggattctatggttttttgcttatagttttccagtttcaataaaaatttgatcgaagaaaccgatttaaatatatccaggtattcaaaatcccgaaaatgttccggaatcttataatggtctgcttttgccttcaggtaaggaatgtcgaatcccacaccgttaaacgtaatgatggtggtatatggtgacagcatctgaaaaaatgcggcgaggatttcagcttcttcttccggtttttcagcaaaaaactggtcaatacagatccggttgcttttgcgtctggcacatccaatcatatagagtgtggaatttgcaggtgaaaacccggtagtttctatgtcaaaaaatatagagtgttcatcaaaaagctggtcggtgagagcgtcctgacagagatcggggatttcttcatgaaacgttttcataaattctcctttatataacgtttggattttgtctgtgtgtctggattataccataaatctcatttttcgtcatgtttctttgtattaaaaagaatacaaaatattcagaaaaaattaaaaattttactacatacatggttaaaaagtgctataatttaatttgaattatgttataaactatatggtttggacaaaaaaataaggaaagagggcacaaggatgggtttgaaaacatttataggcggcgtacatccctatgaaggcaaagaacttgccaaggatgcgccaatcaaagaagttctacccaaaggagaactggtttttccattgtcacagcatattggtgcaccagccactccaattgtcgctgtaggggatagcgtaaagaaagggcagaagattgcagaagccggcggctttgtatcttctccgatttattcttcggtatccggtacagtgaagaaaattgaaccacggcgtgtggcagtcggtgatatggtgaattccattgtaatcgagagtgacgatcagtttacggagtgtgagtattcaccggtggatgatgtgacatccttatccagggagaaaatcattgatcgaattaaggaggccggtgtggttggtatgggaggcgcaggtttcccgacacatgtaaaactgtctccgaaagagccggaaaaaatcgagtatattattgcaaactgcgcagaatgcgagccatatctgactgcagattaccgcagaatgatcgaaaatccggaagatctggttgcaggtatgaagatcatactgcagctgtttgaccatgcaaaaggtgtgtttggcgtcgaaaataacaaaccggatgcaattgcaaaactgaaggaactgattaaggatgagccccggatggaggtctgtgaattgctgacaaagtatccgcagggaggagagcgtcagctgatctacgcagtgaccggacgcgaaatcaattccaaaatgcttcctgcagatgcaggctgtatcgtggacaacgtagaaaccatgattgcaatcaagcatgcagtaaaagatggagttcctgtgatgaagcgaattgctacaatcaccggagacgcaattaccaccccgtcaaactttttgtacagtatggggacaccatacgagcagctggtggaagctgccggaggatttaaagtacagccggagaaactggtatccggcggtcctatgatgggatttgccatttttggactggatgttcctaccacaaagacgacttcttctctgttatgtcttggaaaagatgaggtggcagagtttgaaccgctcgcatgcatcagctgtggccggtgtgtggaagcgtgtccggaaaaactgattccaagcaggcttgcaaagttcagtgagcacggacaaaaggatgagtttgaacgctggcatggattagagtgcatcgagtgcggaagctgcagttatgtatgtccttcccgcagacaggtggcacagtccgtcaagacaatgaagaaactcgtattagcagataagagaaagaaaaaataagagaaagaggtggattgttgtgagtgagaaatatcaggtttcgtcttcaccacatgtgcgtgccaaggactccacaagcagagttatgctgtatgtgatcatcgcgttgctgccggcaaccctgtttggtatctggaattttggaatgcatgcattacttttgattttagttaccatcgcaagctgtctggcttccgaatggatttttgataagatcgtacataaaaaaaacagcctgccggatctgagtgcggttgtcaccggacttcttctggcactgaacctgccggcaggacttccatggtgggaggctgtgattggcagtgtatttgccattgtcattgtaaagatgatgtttggcggactgggacaaaacttcatgaacccggcactgggtggaagatgttttctgctgattgcttttgccgcagacatgacaaatttcaagagttctaagtttgaggcatattccggggcaacaccgcttgccatgatcagaaatgaaggactttcttccgtcaatgtcatggatatgctgacaggaaagattccgggaaccatcggtgagacatccgtgatcgcaatcctgattggtgcgatgatcctgattcttctgggcgttatcacattacggattccggctgcttacctgattacatttgcggtatttatgctgatctttggcaaggaaccgatgaatgccaattatctggttgcagaactgtgcggtggtggtctgatgcttggtgcattctttatggcaaccgattatgtgacttcaccgattacaccggccggtcagattatttacggtatctgctgtggtctgttaaccggtattttccgctgtttcggagcaaatgcagagggtgtttcttttgcaatcatcctgagcaatattttagtaccgattattgagaagtttacaattccgagagcttttggactggcaaaggaggcaaagaagaatgaataaacagattatacatgacgctttggttttgacagcctttacccttgtgatcggcgtgattttaggagctgtatatggaattacaaagactccgattgacaaagccaacgagcagaccaaaaaagaagcgtatcaggcagtgtttgcagatgcctctgggttcaaccagcaggagtatgatgcggatgccgcagacaaaatggttgcagatgcaggatatgacgatacgattgacgatgtcgagcaggccatagataaagatggcaatgcactgggatatgtcattaccgttaccgcaaaagacggaagccagggaagtattacattttccgttggtatcaagaatgatggaaccgttaacggatattcgattaccgatatttccgagacgccgggacttggtatgaaagcagaagaggaagatttctacagccagtttgaaaacaaaacggtagacaagtttacggttgtaaaacaaaaaccggcatcggatgatcagattgaggcaattaccggatctaccattacttcaaaggcaatggcaaatggttgtaatgctgccatctattacttccagaatgcgttaggaggtgctcagtaatgaacaagtatgtagaacgtttgtacaatggtgtgatcaaagagaatcctacctttgtcctgatgcttggtatgtgtccgacacttgcggttacatcttcagcgatcaacggacttggtatgggactctctacccttgtggtactggtattttccaaccttttgatttcactgttccgtaaggtgatcccaaacggcgtgcgtatgccggcctatatcgtgattgtggcatcacttgttacggtcgtacagtttctgatgcaggcatatcttccaagcctttctaaggcacttggtgtgtatattccgctgatcgttgtaaactgtatcattcttggccgtgcagaaagctatgcatccaagaatggtccaatcgaatcaatttttgatggaattggtatgggacttggatttaccatgggtctgactatcatcggactgatccgtgagatccttggtgccggaacctttttcggacttccgttcctttccgcaatcaaaggatttactccgatcacgattttcatcatggcaccgggagcattccttgtactggcattccttgtagccggaatgaatatcatccgtaaaaagatggaagcaaagggcaaaccgcttgcagagccggcaggatgtttatccggagactgtgcacactgtggtcagtccgcactttgtacaggaaagagtgcaggagcttctgatcaggaacaggcataaggagggagagagacgatgagtacattagctgaactggttttgatcgcggtaggttctgcgatcgtaaacaacgtagtattgagtcagttccttggtatctgtccgttccttggtgtatccaagaaaacagagacagctgctggtatgggaggtgccgtaattttcgttattacgatctcttctttcattaccggactgatctataaatttattctggccaatccgtttctcgtgaaaaagggaattgatctgacctatttaaagaccattgtatttattctggttattgcagcactggtacagtttgtagaaatgtttttaaagaagagcatgccatcactgtatcagtcactgggtgtttacctgccgctgattaccacaaactgtgcggtacttggtgtagccttaaactgtgttacttacgattacaatctcttagagggtgttgtttacggattttccacagcatttggtttctttatcgcaatcgtattgatggcgggaatccgtgaaaaaattgagtacaatgatatcccgaagacatttaggggtacagcgattgttctgatcactgcctgcctgatgtccattgcctttatgggattctcaggaatgatttaggagggaaaagacgtatgataactggaattattgtcgcagctgttgttgtcggctgcgtaggaattattcttggatttttcctcggaatcgccggagaaaagttcaaggtagagactgatccgagagaggatgcgatcttagaagttctcccgggaaataactgtggtggctgtggatatgccggatgttccggacttgctgcggcaatcgcaaagggagaggcaccggtcaatcagtgtccggtcggtggagagccggttgccgcaaaggttggcgagatcatgggtgtttctgccggggcttcggtaaaaaaagtcgcttttgtcaagtgtgccggaacctgtgagaaagcaaaacaggattacgagtataccggagtggaagattgtgcggcaatggcatttgttccaaatggcggaccaaagtcctgcaattatggatgtctgggatttggaaattgtgtgaaagcatgtccgtttgatgcgatccatgtcgtagatggtattgcaaaagtcgatccgaaggtctgcaaggcctgcggaaaatgtgtggctgcatgtccgaagcatctgattgaacttgtaccatatgaggcaatgcacctcgtacagtgcagttccaaagacaagggcaaggatgtcatgagtgcatgttccgttggatgtatcggctgtcatctctgtgagaagaactgtccgtctgatgcgattcatgtggtagacaacattgcatacatcgatcaggaaaaatgtacaggctgcggaatctgtgcagaaaagtgtccgaaaaagattattttataacaagaaataaccccatgcagggtcagcctgcatggggtatttttatgcagagtttttcagaacacgaaaatcaggaggcatgaaactgtatggaatcatcccggttgattccggaactgcatgtaattgttccgtcatcggagacaaagatggcttccacgccatcggtctgttccaccagctgcattcccttttttaatccgagggaaaaacaggttgtgctgagtgcatccccgtccatggagatgtcactgatgatggttacctgatagagatggttctcgaccggatatccggtcgaggtgtctaaaatatggtgatacagtttgccgttgacccggtaatagcgctcataaataccggaagaaacaaccgaagcatcggatacgtttaaggtgccaagtgacgtaccggtttcggaaaatggtttctggataccaatggtataggaagagtgatctgcctttttcccaagagtcaggacatttcccccaaggctgatcacgccggaggtgattccttttttgttcaggaaacttcgcatttcatccgcaatgaaacctttcgcaattccgccaaggtcaattttggcctgcggatctttcaaccgcacctgatttcctttgatctcaatatttttatagttgacatgtgccagtgccgcttcaattttttccggggaagggacaaccgatgcatcgacttcgttctcatcggattttgcggtttctgcaatctctgaaaaattccacagatccgagagagtaccgatggtaatatcaaatgctccatcactgatttttccataccggataccatctttgatcagggagagggtatcgctgctgactgtcacaaactggccgtttgcctgattgatctttgaaacttcactgtctgtgatggtgtttgaaagtttcttttcgtagtttcctgccagggaaaagcaatcatccaatatcttttcatcacgggttccatagagggtaaccgtgatcatcgtatcaaaataaaatcccgttttggatattttcccggaattggcagagcagccacaaaaaagtgatgcaataaggcaaagaagcgttgtgggcaacagaatgtatctgatgtatttttgttgtttcataaaaatcctctccgtaaaattttatacagattaatatactccattttatggcaggcggcaagctttgttgttttttttcggaagatatggtaaagtatttaaaggtatgcataagtaaagaaaatcgaggaataaagtacaatggacagtaaactgaattataaacgtatcgtgatcaaaatcggttcttcctctctgactcacgcagagaccggccgtttaaatcttgccaaaatggaacacctggtcaggcagctgagtgatctgcacaatcagggaatggatgtctgtctggtaagctccggtgcgattgccgtgggaagggctgccatgggcgtgaaggaacgtccgtccgagacatcggtaaagcaggcatgtgcggctgtgggacaggcaaaactgatgatggtttaccagaaactgtttgcggaatattcacagaccgcagggcagattctgttgacaaaaaatacaatggtaaatccggtatcccgtgcgaatgcaaagaatacatttgacgaactgttccatctcggggtgattccggtcgtgaatgagaacgatacggtcagtacctatgagatgcagtttggtgacaatgatacgctgtcggcactggtcgcttccatggtgggggcagatcttttgatcctgctttccgatattgacggactttatacagatgatccgcacaaaaacccggaggcaaggctgcttaaagtcgtggatgctattgatgaaaacatttatggaatggcaaaagaatctacaggcagcaatgtcggaaccggcgggatggcaacaaaacttgccgcagcaaagattgcaacattatccggaacggatatgatcattgcaaatggcggggatgtccgcatcctgcaggatattttcgaaaatgattatgtgggaacgttatttacggctaatgaaaatgcaaactttaaccttgcaaattatattatggagacgataggctgatgacaaacgaaaaaattgcacgcatcaatgaattatacaaaaaatccaaagcagaaggattgagcgaagaagaaaagaaggaacaggcactgctgcgtcaggaatatgtcgcttcggtaaaggcaaatctgcgcaatcagcttaacaatattgacatgatgaatgcagatggatctgtggaaaatcttggagaaaaatatggatcaaaaacaacaacttcgtaaacggatgaaggaaaagagagaccggatttctccgcaggagaggcggcagaagagcgcaaaaatctgtgagcggctgctgtcggcaccggagtatgccagatttcagaaaattctggtttatgccgcgattagaagcgaagtcgaattgcagcttttctgcgatcaggcactccgggacagaaagcagatttttttcccgaaggtgtgcgggaaggaaatggagttttaccggattgagaatcccggacagttaaaaaagggaatgttttctgtcccggaaccggatgtcaaacaatatccgctttcttcttttgcagagaatggggaggcatggattcttgtccccggtgttgcattcgacgaaaaggggatgcggctcggatacggaggaggattttacgatcgttacctgaagcagaaagaaaatctgcacaggacaggaattgcgtttggagaacagatcgtcaaaagaattccaacggaaatacatgatcatcctatggatgatgtgattacagaacaacaatggtatcgtccgaaacggacaacaggaggagaatgacaatggatgcaaaactgcaggaactgtgccggcaggcacatgaagaccggatcagggttggaatgctggataccgatacaaaaaacagaacactcgaactggctgcggatgcgcttatggcacatgagcaggaaattttagaggccaatgcaatagatatggagcggggacgtgagcgcaatatgccacagggacttttagaccgcctgaagctggatcatgaccgtcttcttggaatggcagacggactccggcaggtggcgaaactggaagatcccatcggggaagtgatgtccatgcgaaaacggccgaatggactgatcattggaaaagtgcgtgtagccatcggtgtcgttggcattatctttgaggcccgcccgaatgttacttccgatgcgttcggtctgtgttttaagtccggaaactgtgcaattttaaagggtggaagtgatgccatccattcgaacattgcgattgtttctgccatgcaggaggcacttcgcaggatgaatattccaaaaggggcactcagtctgatcgagagcacagatcgggaaaccaccaatgcgtttatgaaaatgaaggattatgtggatctgctgattccaagaggcggcaggggattgatccagagtgtggtaaataatgcgacgattccggttattgaaaccggaaccggaaactgtcatgtttatgtggatcagtttgctgatcaggagatggcggtcaatatcattaaaaatgcaaagacacagcggatcggtgtatgcaatgcctgcgaatccattgtggtgcaccgggcaattgcaaaagagtttcttccaaagctgtatgcagcattaaaagagtatgatgtggagatgcgcggtgattcctatgccgtcgaatgtctgggaccggatcagccactggtaaaagatgcgacagaagaagactggggaacggagtatctggattatattatgtcggtaaagattgtagacagcctggacgaggcaatcgcgcatatcaataagtacaatacctcccattctgaggcaattataaccaaaaattatgatgtggcacagagatttttaaatgaaattgattccgcctgtgtctatgtgaatgcatccacccgtttttccgatggaaatgaatttggtcttggcgcagagatcggaatcagcacacagaaattacatgccagaggtccgatggggcttgaggcacttaccagttataaatatattatttatggaaacggtcaggtacgtccataaaagaagagcaggaaaataagaggattatgagagatttagaaataaatggattaaccggggaagaagaaaccagacggcagtacgaatacatagaaaaagccagacagtatgtggcacaaaaggaaaaagaagcggggcgcaaactgacctgctgtgtccatacgtttgggtgtcagatgaatgcgagggactcggagaaacttttaggaatcctgacggacatcggttatgtggagacagaggatgagcacgcggactttgtgatttacaatacctgtacggtgcgtgaaaatgcaaacaataaggtgtatggacgcctggggtatctgtcaaactttaaaaagaaaaatccgcatatgatgatagcactctgtggctgtatgatgcaggagccaacggtagtggagaagatccgcaaatcctaccgttttgtggatctggtatttgggacacataatatttataaatttgcggagcttttatgcaatcgtatggaatcggattccatgatcattgatatatggaaggatacggataaaatcgtggaagatcttccaatccggcggaagttttcttttaaatccggtgtcaatatcatgttcggatgtaataatttctgcagttactgtatcgttccttatgtcaggggccgcgagcgcagccgggaaccgaaagatatcatccgtgagattgaaggactggtggcagatggtgtgtgtgaagtcatgctgcttggacagaatgttaattcttacgggaaaaatttagagcagccagttacgtttgcagagcttctccgggaagtaaacaaaatcgagggattaaagagaatccggtttatgacttctcatccgaaggatctgtcggatgatctgatccttgccatgaaggaatgtgataaggtatgcaagcatatgcatctgccgctgcagtccggaagctcacggattttaaaaatcatgaaccggcattatgataaagaacagtatctgacgattgtaaagaaacttcgggaggcaattccggatattgcgctgacgaccgatattattgtcggattccctggagagacagaagaagatttccaggaaacgcttgaagtggtaaaacaggtggaatatgacagtgcgtttacgtttatatattccaagcggaccggcacaccggccgcagccatggaagatcagtgtgatccggccgaagtgaaacggcattttgatctgttgttaaaggaagtacagcagatcagtgcaaagaaagccatggcactggaaggaaaagtgatggaagtgctggcagaggaacagaatacgcaggatgcttctctgattaccggacggctttcaaacaattcggtggtgcattttccgggaaccccggatatgattggaaaactgtttatggtaaaacttacggaatgtaaaggcttttattatctgggagagatcgcagagaatgcatagaaaatttggcaaaaaagatgtgatttttatcggtgcgcttcttggtatctgtcttattgtactgggcgtctggtattttgccggagggaaacagggagcttctgtggtggtgacgagagagggagaagtgtatggaacctattccctgtcacagccgcagactgtaaaaattaaaaattccaaaggaaaaaccacgaatgttctggtgatccgcgatggaaaagcagatatgaaagaagcggactgtccggacaaactgtgtgtgcatcagaaagcgatttccgcggaaaatgaaagcattgtctgtctgccgaatcgtgtggtagtgaccgtaacgaattcgaaaaaagaagggatggatggatttgcacagtaaacagctttggagaaaaacggcgtttatgggagtgtttctcgcacttgccatgatctgcagttatatagagatgctgattccctttgattttggaattccgggagtaaaactcggactgacgaatattgtggttgttttaatgctgtattcgattggaacgaaggaggcattttgtgtctctgtcataagaattttcattgtcggcattttgtttggcaatctgatcggaattttgtattccttaggcgggggaatccttagttttcttgtgatggcactcttaaaaaaaggaaaccacctgggctgtatttccgtcagtgtggccggaggaattgctcataacatcgggcagatccttatagcggcgcttgttgtgtccagccattatgtgttgtattattttccggtacttctgattgccggacttcttacgggatttctgatcgggcttcttgcacaggaactgatcgtgcgtctgcgttttctgacagaaaaatatcacgagtagaacatctgtttgcataattgtatctgctgtgttatgataaatatcgtgaacgaacgaaaatgaggagaatgttttatgtacgcatatatcaaaggtgagcttgcagaaaccaatccagatcatattgtgatagagaccgggggaattggatatcaggtatttatttccggacagacgtttgagtatcttccggcagtcggtgaggagattaaagtgtatacgtatctgtatctgcgcgaggatgccatgattctctatggatttctgaccaaagacgatctggagcttttcaaacttctgatttctgtcagcggaattggtccaaagggaggacttgcaattctttctgcgctcagtgcagatgatctgcggtttgcagtattgtcgggagattccaaggcaatctcgaaagctccgggagtaggagccaagacagcccagcgtgtgattttggaattaaaagataagatgtctttggaagatgcttttgaaaagaagagtgagcatgtacagactttaaagatttccggaaatggtcaggtcagaaatgatgcggttatggcacttacggcactgggatattcctcggcggaaagtttaaaggctgtatccgcggtggagatcacagaagaaatggatgtggaagcagtgctgaaggcagcactgaaacatatgtcgttgttgtagtttcgagaaagaagatttggtatggaaaaacgcgtgatttccacgcagctgcaggaagaagattataagattgaatcgtcccttcgtccgcagaggctggaggattacattggacaggaaaaaataaaatcaaatatgaaagtctacattgaggcggcaaaagcccggcaggagtctttggaccatgtactgttttatggaccaccgggacttggaaagacaacgcttgcagggatcattgcaaatgagatgggtacccacctgaaagtgacctcgggacctgcaattgcaaaaccgggagagatggcggcgatcctgaataaccttgcagaaggtgacattttgtttgtggacgaaattcatcggctgaaccgtcaggtggaggaagtgctgtatccggcaatggaagattatgtgattgacgtgatgatcggaaaaggagaatccgcccgttccatccggctgaatcttccgaagtttacgcttgtcggggctacgacacgggccggaatgctttcggcaccgcttcgcgaccgttttggtgtcgtcagccacatggaatattatacggtggaggaacttcgcacgattattttgcagtcggcacaggtactggatgtggaaattgatgaaaaaggcgcttacgagcttgcccgccgttccaggggaactccccgtctggcaaaccgtctgctcaagcgggtgcgtgattttgcccaggtaaagtatgacgggaagattacctatgaggtggcggcgtttgcactggatctgcttgaggtagataagatgggactggatcagaacgacaggaacattatcttgacgattatcgacaagtttgacggcggtccggtgggactggatacgctggcagcttcgcttggtgaggattccggaaccatcgaagatgtttatgaaccgtatctggtcaaaaatgatttcatcaaccggacaccgaaggggcgcgttgcaacggcatttgcctatgaacatttcgggagaacaccaaaatccgaataagaggttgcttttcctactgcggaatattataataaaaaatatgacagcaaagaggatggtccaaaacgggaggataggttatgtcagcaaagacaagtgcggaagtggtaattgatggaaaggtatatacgttaagcggctatgaaggagaggaatatctccagaaagtagcttcttatattaacggaaagatcaatgagtttacttccattgaagaataccggcacattcctctcaatatgaaaaatacactgatccagctgaatattgcggatgattattttaaagcaaaggatcaggtggaaaaattagaacgggaccttgaaaataaagaaaaagaaatttacgatttaaagcacgatctgatctctaatcaggtaaagacggagacggcagaagaatcattgaagaaactggaacgggacaataaagaacttctcctgaacaaggcgcggttagaggcagcacttgaggacaagcttctggatggaaaagacagcccgaaagagtctgaaaaagagaacataaagaaaaaataagaggtttcgaaacacaaaggaaggtattcctttgtgttttttcatcataaggaaagaatatgaaagaaaacaatcatacgacacaacaaaatacatttgaactgcttgcaccggctggatcgttagccatttttaaggcggttgtcgcggccggcgcagatgccgtttacgtggggggaagcaaatttggagcccgcgcatatgcagataatttttccgatgaagaattactagaagcactggactatgcacatttgtatggacgcagggtctatcttacggtcaacacgcttttaaaaaacagtgagatcgaacaggtctgtgcgtatctgcagccgttttatgaacatggcctggatgcggtacttgtacaggattttggagtcctgacagcaatccacgagagatttccggatcttgcgattcatacaagtacgcagatgacagtcaccggtgtggaggcggcccggcttttttcaggatacggagtgacccgtatggtcatggcacgggaactttccctgaatgaaatgaaacggatccgtgaagagaccggtatggaactggaagcatttgtacacggggcgctgtgttactgttattccggacagtgtctgtttagcagtatgcttggaggaagaagcggaaaccgcggcagatgtgcgcagccatgcaggcttccttacgcagtgctggatgaaaagcacagggaatacaaaaaagatgcttatgtcttaagcctcaaggatatgtgtggaataaaggatctgcgtgggctggcagatgcaggagtctattccttgaaaattgagggacgcatgaaacagatcccgtatgctgccggtgtggtttcttattaccgcaaatatattgacctctttttatcgggacaggagacacaggtttcggaaggagactaccgggcagtgcttgcgctgggaaaccgctgtggatttaccgacggatattaccacaggcacaatggttctgatatggtgacgtttacaaagccaaattacgaaaaaacgaatgaagccctgcagcagcaaattttaagaacctatgaaaatggtgctgccaaaatccctgtcatgggagaactggttttgcatcagggacaggctgcacattaccgggtaaagacgcaaacggtgtctgtggagatttccggcatggaagttatgcaggcgcaaaagaaaccacttctggcagaagacgtaaaaagtcgtatggaaaagaccggagataccccgtttgttatggaagatttatccataaggatagaagacggggtgtttcttccaaacggagcgctcaaccagttgcgcagggaggcattggcagaactgcaaaaagagatgctgaaaccttaccagagacaggatcatccgcagaggaaggcagagaaaaaatttccggaggcatgtgagaaacgggaaaaacgaaaggaatgtgtttttgcagtgaccggggagcgcagacagcttgcaccggttctggaaagttcctgtgtgacttctgtctgtctggacatggaagcttatgaccgaagcacaatgatggaagaattaaaagaagatgcaaatgctgttatgcaaaaggataaagaggtttatctggcgatgccgcgtatcttccgtgccggaacggcagaatgggtgcggcagatacttccggatataaaaagaatgggatttgccggagttcttgtgagaaattatgaagagctggcattggcaaaggaaacatttttgggaagtgaaatcataacggatcacaatctgtattgctataacgatcaggcggtccgtgcattttccgggcagggagtgacaaaaaatacggttccgctggaactaaaccgcagcgaaataaaacggagatataacgaagaaagtatgatgatgctttacggatattatccgcttatgacaagtgcacagtgcgtacatgccaataccaagggctgtgacaaaaaacgggggctttcttatctgaaagaccggtatcaggtacagtttccggtaaaaaatttctgcacgtactgctataatgttgtttataattccctgccggttttattattttccaatttagaggaattaaaaaaagcgggagtccgtgatttccggatggattttaccatggaatccgcaaaagaaaccggagcaattctgaaattatatgaagagtttgcagacggcagccgcagacagtatccgaaagaatgggaaaaccgctataccaacggacactataaaagaggagtggaataatgatccatctgattgttcaggcttcaaaatatctgatgatctttttgttccttgtttatacatttgagtgctttcatgtgtttaaattcgagggagaggaagaggaacaaaaacatatttaccatgtacagagaacactgttgtttctttttcattttgatgcctttcttgttttgtatattacaacaaaaaattttcagctgatcggattttatctcatgcaggtgattatcattgcggcaatcatcggaacatatcatctgttttacaagcatgcatccgagctggttctcaataatatgtgtatgttacttacgattggatttgttatcctgacacgtatttcttttgaaaaggcattccggcagtttatctttgtgtgcgcgggttttgtgatttccctgctgattcccatgatcttgcagaatatgacgctgttccgtaaactgacatgggtgtatgtgatcgtaggtgtcggtgcactgggcgttgttgcgattgccggacagacaagctatggggccaaactgtccctgtcgatcggtcctttgaccatccagccttcggagtttgtaaaaattatttttgtcatgtttattgcatccatgctgtaccagcgccaggattttcatcaggtcatggtgacaagcattttttcggctgtttttgttctgatgctggtagcatccaaagatctcggcggagcccttttgtatttttttacctacctggttatggtttatgtggcgacgcgcagatttgtgtatttcggaggtggaatactggcaatgatcgtggcgagtctgcttgggtaccggctgtttgaccatgtacaggcacgtgtgcaggcatggtcgaatccgcttgcagtcattgacggggcggggtatcaggtatgccagtctctgtttgcaatcggtaccggaggctggtttggacttggtctgggacagggactgccggaaaaaataccggtcgtgacaaaggattttgtttttgcggcaatctcggaagaactcgggggagtctttgcactgtgtctgatcatggtctgtgtcagctgcttttttatgatcatgaatgttgccatgaaacttcgggacaattattatcgtctgacagcggtcggacttggaacactgtatgctttgcaggtgtttctgaccatcggcggggtcatcaaatttattccgtcaaccggagtgacacttccactggtcagctatggaggcagttctctgttatcgactatgattgtgtttggcattatacagggactatacatcatgcagtttgacggccggacgcagaaaaaagaacagaaacgaagaagaggcagaaaagaatgagaagaaaaaagaaaaagataaagaaaagtaataaagaatttcttgttattatgtatctgttcctggcagtgtttctgtctatgatgatttattttgtctattttcaggtatgtaagagtgaatcgtttatcaacagtccgtataattccctgcaggatctgttttcggatcatgtgatccgtggggatattgtatctgcagacggcaaagtacttgccacaacaaaagtatccgcagacggaacacagaccagaagctatccgcagggatgcatgtttgcccatgcagttggttatgcggtgaatggaaaagcgggactggaaaaccaggaaaatttttctttgttgcgttcccatgagtttttccttaagagaatcgcagatgatatttcagataagaaggcacagggggatacggttgtcacgacgctggatgcacagattcagcaggtggcatacaaatctcttggaaattatcagggagctgtgattgttatggaaccggataccggaaaaatcattgcaatggtgtcaaaaccggactatgatcccaatacggtaaaaaaggactggagcagtctgacggcagagggaagcacggtgctttacaatcgcgccacgcagggaaaatatgcgccgggatcggtgtttaagatcttaacgaccctggagtattatcgtgagaatccttctgcctatgaccagtatgcgtttgactgcagtggttctatttcggttgacgggcagaccattcactgtgcgggaaataagcatcacggtcaggaaacattaaagagttccttttctaattcctgcaattcttcgtttgccaatatttcactgtcactgaaccgagagaaatttaaacagacctgtgacagcatgctgtttaatcaaaatcttccgattgcttttgagtccgggaaaagcagtttttctttaaataaaaatgacagcaatgcaatggcgatggaaacgggaattggtcagggaaaaacactggtttcgccactgcatatggcgctgatagcaagtgccgtggatcatgatggaattctgatgcgtccgtatctggtggatcatatacaaaatgattccggggttgaagtaagcagcaataaaccgaaaacttatgcgacactgatgacggagacggaagccggtttgttacagcagtatatgcgtgcagttgttacagatggaacgggaagaaaattatccggacagtcttatgaagcttccggcaaaacaggaacggcgcaggtatcggacacgtcggatcagacaaatgcctggtttgtgggatatgcaaagaaggatggctataaagatatcgcaatcgcagtcgttgtggagaacagtggtgcgggcagtacgtacgcggttccagttgcaaagaacgtatttgacgtatattttaacagatgatatacttgctatgaaaataatgaatgtttgcacatatatgtgcagttttcgcacacgggaggattgcaatgattgaagcaataagctgtggcggagtggtaatctttcgtggcaagattctgcttttgtacaagaattacagaaacagatatgaaggctgggtattgccaaaaggaactgtggagcagggagaagagtataaggatacggcaattcgcgaggttttggaagaaaccggagcaactgcaaccattattcagtatgtgggaaaaagccagtattcatttaccattcctgaggatacggtcgagaaatcggttcactggtatctgatgatgggcgaaagttattatagtaagccgcaaagagaagaatattttacagattccgggtattataaataccatgaagcatatcatttgttgaaattttcgaatgaaaaacagattttggagaaagcttataatgagtatctggatctgaaaaaaagtaacttatggggaacacataagtatttttagaaaggataatctgcatgaaatggtatgaggatctttatgtcggcgattccattgcggacaaagccaatcgaataaagtggaagattaaccatcatgcaggaacagtctctatctatgtgattgcgtttgcatccaaccggcagaatctgctggatattataccggcgtgggaactgatgcagaaatcttatccggggaaaaaacaaatgcagatcatcggtctggcaaaaggttatgcggaagctctggagctggtgcgcagtattatagaggaagtatatcagaatacaggggatgtggatgtaaaatcttatttacggagccggaaacggaggagacaggtatgagtgttttccttctgattctgaaaatcataggaattgctttgctggtgattttaggactgattgttgtcattgctcttttggcattattttgtccattcgtgtatcgtgtgaaaggttcctaccatgaaaaaaatctgcaactgcaggtccggatctggtggcttggccgtctgctggggctctgtgcagataccgcggaagagggattccacacgtatgtgcggatttttggatttcgaaaggaactgcatctgcagaaagaaaaagaagattccgcggattttaaaaagccggtgcaggaagactctccgcaggaagggataaaagaccgggagactgaagtggcaccgtctcttacggcaatggaaaatacatcccaaacatctgcgcagcaattgacagatccggaggagacaattctctgtcatccggataaaaaaaagaaaacattttttccgggcaggattgcaggttttatccggaagttcccggaaaagatccgcaatattttgcaaaagattctttattttttgagaaatatacagacattctggaaaaaaggaacgcgaacgtgccggaaatggtatcgttttttcaatgacgagaaaaataaaaaagcgttttctaatatctggaaacagctggaacatctgattgtttcagttttgccgaaacggctgaagctttggctgaaatattctaccggatcgccggatactaccgggcaggtgcttggtattcttgcaatatttccggtcggataccggaatcactggaatattattccggattttacggcagaagaattttatgcagaagcagattttacagtacacggcaggattttcggagttcagattcttgctctggcactgcgaataattcttgataagaattgccggagactatataatagatttaagcatatgaagtagaatgggtaaggaggttttaccatggcagataacagttttaataatacagtagaatccttatttaaaggaatggacagctttatcacaacaaagaccgtagtaggagatgcaattcatatcggagatacgattattcttcctctggtagatgtatcttttggtgttgcggcaggagcgttttcacaggaaaagaaaaataatggtgccggaggtatgggtggaaaaatcaatccgagtgcggttcttgtcatccagaatggagtgacaaaacttgtgaatatcaaaaatcaggatggaatgacaaagatccttgacatggttccggattttatcaataaatttacatccggaaaagatacggatgatatcattgacgatgttgtttcggatgatacggacaatgaatagaaaaaacagaatcatataaaaccgggagagcatatattagaaatgatatatgcttttttggtggaaaaaatgaaacgggtatggggatatacattgttctggatgggaatcggaatgctgatcatgttttttgtaggtggagggctgctgggggttctgctgattgccggaaccatgcttgtttcctatctgttgttttcctgctgattgaggcacaaaaaaagaaccgtcatacaacggttcttatatttgcttactaagctctctcaacttttccggatctaaggcaggaagcacaaacatataacttctgtggtactccgtttaccttacaacttacacgtttgatgtttgatttccaaactctattagatcttctatgagaatggctgacattatttccgtaatgtacacccttttcacaaattgcacactttgccatgattttgcacctccttgcatttcactaagctttttcaagctcacaacataagatatattaacagattccttctgtaaatgcaagaaaaacttataaaaaaatgaaataaattacatttggtttacatttgcaggaaaaatggttataatacgagtaactatgatgtaatacctatgagatggtttacgaatattggaggtacaagtatgaagggacagatagatacccaatatggaaaggttttggtggaagacgatgtcattgccacttacgcaggttctgttgcggtagaatgttttggtattgtcggtatggcagctgttaatatgaaagacggactggtgaagctgctgaaaagggattatctgacacatggtatcagtgtcacaattgaagatgaaaatctgatcaatattgattttcatgtgattgtcgcttacggcgtaagcatttgcacagtttctgacaacctgatcgagactgtaaagtataaagtggagtcatttacgggcatgaagatcaataagatcaatatctacgtcgaaggcgtccgcgtgattgactagggaggataagaaattggagattacaagtatcaatacggagagtttgtccagaatgttccttgcaggtgcaaagaatctggaggcaaaaaaggaatggatcaatgaactgaatgttttcccggttccggatggagataccggtacaaacatgtcaatgacgatcatgtcagcagcacgtgaagtcggtgcgttgtccaatccgacaatgaaagaacttgcaaaagcaatttcttccggttcccttcgtggggcaagaggtaattccggcgttattttatcccagctgttccgcggtttctgtaaagttatcaaagagtatgatgaggtagatgtttctgttttatgtgatgcattccagaaagcggtagaaacagcatacaaagcagttatgaagccaaaagagggaacgattcttaccgttgcaaagggtgcggcagacaaagcgcttgatctggcacaggagacagaggatctggtttatttctgcgatgaagtgatcaaacatgcggagtatgttttaagtcagactccggaaatgcttccggtcttaaagcaggcaggggtagtggattccggcggacagggactggttcaggtgttaaagggagcctatgattcccttctcggaaaggaaattgattattccattgaggagactccggcatctgcaggcacggcaaaagttttagagccggctgagcaggagattaaatatggttactgcacagagtttattattgtattaacacgtccattgtctgaaaaagaagaaaaggaatacaaatcttatctggaatctatcggagattcgattgttgtggtagcagacgatgaggttgtaaagactcacgtacataccaacgatccggggcttgccattcaaaaggcactgacccatggttctcttacaaagatcaagatcgacaatatgcgtgaggaacatcaggaaaagctgattaaggatgccgaaaaagcggctgcccagcagaaggagcaggaggcagagaaagagaaaccccgcaagccaatgggatttattgccgtttccatcggtgagggaatgaatgagattttccgcggactgggagcagactatctgatcgagggtggacagaccatgaatccgagcacagaagacatgcttgcagcaattgatcatgtaaatgcagatcatatctttattctgccaaacaataaaaatatcattatggcggcaaatcaggcagcggagctgacagaggataaagatattattgtacttccgactaagacaattccacagggaattgtggctctggtaaattatattccggattatactgcggaggaaaataaggaagccatgctggcagaactcgacagtgtaaagaccggtcaggtgacctatgcggttcgtgacactgaaattgatggcatgcagatcagacagaatgactatatgggaattggcgataaggcgattcttgcggtcggcacggatctgaaagagacaaccatgaagatgattgatgcgatggtagatgaggattctgcaattgtcagcatttattatggtgcggatgagacagaagagcatgcacaggaaatcggaaaaatgatcgaagaaaagtatccggatgttgaggtagagatcaactgtggtggtcagccgatttactattttgttatttctgtagaataaaagttactatttatgcagcacagaaacgaataaggagcagatatgcgtcaggattcatcaatcacggaaatcaaaggcattggtgaaaaaacaaaaaaattattcgaaaaaatgggagtatacaccgtaggtgatatactccttcattttcccagaaattatatacagtatccccatccggtgccgatcgatgagatgacagcggaacatatgcagacagaggataagcttgcgattgttgcacggattgagcgtacaccggtaacgagaagtggcagacatatgcaggtgacacttcttgtgattggaagccctggacatcagatccagctgatctggtatcggatgccttatatacggaatacattgacacatggcaaatattttgttttttacggaaatgttcacattaaggatggcaaatttgtgatggaacagccggtggtgtatacgctggaggcctatcaggaaatcgaaaactgttttcttccggtgtatacgctgaccagcgggatcaccaacaatctcatgataaaaacgatgcggcaggcattggatgaggaagaactgcttacggattttcttccgggagaaattcgtacgcgcagaaaactgtgtgagtataattatgcggtcaaacagatccactttccggatacgatggaacgtttgatcgaggcgagaaagcggttggtttttgatgagttctttttatttatcatgggcatgcagtaccagaaagaaaagagaaccagacaggaaaaccggtttgtgatggaacatccggagttcgtggaagatctgattcagaagcttccgtatgaactgacgggagcacaaagacgagcattgcatgatgtgacggaaaatatgcagggaccgtatgccatgcagcgtctgattcagggagacgtgggttccggtaaaacgattctggcttttctggcaatggcgtggtgcgcacagaatggatatcagtctgccatcatggcaccgacggaagtacttgcacagcagcattatgaaacattccagaaactctgtgagcagtttggactgcattttccggtaatccttctgacggggtccatgacggcaaaacaaaaacgcagtgcgtatgaacggttagaactgtatgagaatgccctgattgtaggaacgcatgcgctgattcaggaaaaaccgacatatgcaaatcttgcgcttgtgatcacagatgagcagcatcgttttggtgtgcggcagagagaggagtttgcgcaaaaaggggatatgccgcatattcttgttatgagtgcaacaccgattccgcgaacccttgcgatcattatctacggagatatggatatttcggttgtggatgaggtgccggcaagacggcttccgatcaaaaactgtgtggttaatacggcataccggccgaaagcatatgcgtttgttgcagatgaggtgaaaaaaggacatcaggcatatgtgatctgtccgcttgtggaggcaagcgaagagacacagggagaaaatgtaattgattactcgaaaacgcttatggaggaactgccatccggcatccaggtgggcgtgcttcacggaaagatgaagagcagtaagaaaaatgaaattatgcaggaatttgcggaaaataaaattcaggtgcttgtatccaccacggtagtggaagtgggggttaatgtaccgaatgcaaccgtgatgctgatcgagaatgcggaccgatttggcttagcacagctgcatcagctgcgtggacgtgtgggaagaggagatgcacagtcttattgtattatgatcaatgcctcttcggccaagacggcaaaaaaacgtctggaaatattaaataaatcaaacgacggcttttttattgcgagtgaggatttgaaattacgcggaccgggagattttttcggtatccggcagagtggagatctggtatttgcgctggcggatatttaccaggatgcggcggtgctgcaggaggcttcggaagaagtaaaaacaattcttgaggaagacccggaactgacagaacccggacatcacattctgcaaaagaaaatgatgcagtttcaggaagaacagctttcaaaaatgaatttgtagattccggcaaaagaaaaagcaggtctccgtgacagagacctgcttttttcttttgtacattgggacaagtgggttactggatgttttctcctttgccagccatctgtctttcctgcgcttcgatcatttttttgaccatataaccgccgacagatccattctgttttgcggtaagatcaccgttgtatccgttgctaagtgggactccaagctcatctgcaacttcatacttaaaacgttccaatgatttttttgtacttctgtctgccatgcttttcttcctcctttgcggttgtactttgtggtacgattctagtatatgcgctaagcagaaagcctatgctggaaacttatgtattgggtgattccaccagtgtcaggccgctgatgtccggatgaatcgtgagagagtagttcgtatagtatacgacaaatccgggtgcacttccggccggttttttcacattttttttctgaagataatcaatttcaagtttgtcactgtcacgtccgctggaatagtaaccggcaagttttccggcctcttcaaatacgcggtccggcatttctccccctttgttttttacaattacatgggaacccggcatttttttggcgtgaaaccaccagtcatttccggttgcaaatttaaaggtcagttcatcattctgatagttatttttgccgacgtacatgtcatagccgtcggatgaaatataatggaaaggtttgcttttgattttctgttttttgccgtttttgtgttttttgataaaaccgtattccatcaattcctctttgatctgcaccagatcatcggcagagagtgcaatgttcaaagaattctggatggactccagatggtcaatctgcgctttggtttccgcaagctggacttcaagagcttcggaagtccgtttcagttttccgtatttatcaaagtatttttgggaattttcacgtgcggtcttttgcggatctaacgggatacggatttctttattgttgtcataaaaattttcacagaccagttcttttgcctggtcctgcagattgtaaccgtatacattgatcagttctccgtacagtttatatttttcccgtttttcggcatctttctgctgcttttgctgtaactggtattttttctggttgcgctctaacgcagttgtgacgatttttcgcaggtctgcggatttctggtggatacggttgtaaatattgcgctctgcatagaaaacttcgagcatctgcgagatgctttccatatgttccatctcataatcctgatacatggtcagttcaattgcagaaaattcgatcggccgtttgtcttttcttacgatcaccggatgaaattcgttgtggcggatttcatcaaaaaaccatgcaatgtggtttgcaagatggtggatttcatcatcggtacaggccaaaagagactgatctgcatccatcccggcccggtatgccagttcggatgcaacaagcggactgacaccggtaaatgatgtatagatagctttgcagatggacatcggttttgccttaatggcatcgcagatctgtgaggcatccatagtcatggcattgaatttgtcctcctgtgtggcaggaataaaatacgggcggcccggaagcacttcgcgcagggaacttacggcggaagagacatgcttgatgctgtcgatcatggtgccgtcctcatcgcaaaagataatattggaatgttttcccatcagttcaatgacaagggtcttatgacagatatcccccatttcattcaggtgttcaatcttcagatggatgatgcgctccatatggggctgggtaatgcttatgatccgcccgtttgcgatatgtttgcgtaaaaccatacaaaatgtaggcgcctgcaggggacttgtcttgttggtgtccgtcagatataaaaaaggaagggaagcgtttgctgaaatggatacacggaactgtccgctgcttcctttgcatgtcaaaagcagctcgtcattttcgggctgcgcaattttactgatttttgtatttaaaatcgtctggttcagttcatggactaaacctgcgattacgattccgtcaaaagccatggaaattctcctgttcatgattatagtgtttttcaaactcatgaatcattatagtaatttccacgtcttttgtctatatgcagaaagtggatatcttttgtatacattttttgcaagaacatttgacgaaacggcaaagaagcattataatacatttatctatgcatagatatgtgcatgatatttgggagaaagtaaaatgattaaaagcatgaccggatttgggcgctgtgagattgcagatgaaaaacgcaaatttaccgtggaactgaaatccgtaaatcaccggtatcttgatgtaaacatgaagatgccgaaaaagttaaatttttttgagagtgcgatccgcagtctgttaaaaaaatatattgaacgaggcaaagtggatctgtatatttcctatgaggactatacggaggacaattatgcacttaagtataatgagggacttgccggtgagtatttaaaatatctgaatgccatggcagaaacattccatctggaaaatgatgtgcgggtaagcacactgtcccgttatccggatgtctttgttatggaagaacaggaaatggacgaagaagagctctggaatggattgcagaaggcaatctgcggagcatgtgaacaattcgttgagacccgtatccgggaaggcgagaacttaaagaaggatctctgtgagaagttagatgacctgcttgccggagtggatttcattgaggagcgttctccgcagattatgcaggaataccgcagccatctgacggaaaagatccaggaacttttgggagatacccagatcgatgagggaagaattgcgacagaggttacgatctatgcagacaaggtgtgtgtggatgaagaaaccgtgcgtctgcgcagccatattacctcgatgaaggagacactttcagagggcggtccggtaggacgcaaactcgattttattgcacaggagatgaaccgtgaagcaaatacgattctctcaaaggcaaataatattgaaatttcagatgtgggaattaatctgaagaccggaatcgaaaagatccgcgaacagatccaaaatatagaataaaggaagcgcgttatggaacagaaaggaaagttagttgttatttccggattttccggagcgggcaaaggaactctgatgaaagcactgctggcagcacatccggacaggtatgcactgtcggtttccgcaactaccagagatccgagaccgggagaaaaagatggtgtggattatttttttgtgacggacgaaatgtttgattccatgattcagaaggatgattttttggaatatgcaaaatatgtcagccactcttatggaactcctcgttcttatgtggaggaaaatttaaatctcggaaagaatgtaattttagagattgagatacagggagcattaaaagtaaaagaaaaaataaaagatgctgtcctgatgtttgttacggcaccggatgccgggacactgcgtgaccgtctggtcggacgcggtacagagactccggaggtcattgcggcacggcttgcacgtgcatgtgaggaatccgaaggaattgaaaattatgattatttagtggtaaacgatacggtggatcacgcatcggctttgattgatcagctgatctgtgatgagcagtcacaaaataccggaagggatcaggagtatcgggtatctgctaatatagattttattaatcatatgagagaaaatctcaaaagcttttcgaaaggagaatgaatatgatacatccatcttatgttgaattaatgaaagttgtaaatgacgagggcgaaatcggtgaagaaccggtggtaaacagccgttactccattgttcttgccacagcaaagcgtgcaagacagatcattgccggagcaaaaccactgattgatgatccggtctgcaacaagccgctttccattgccgtggaagagttataccgcggagaagtaaagattgtacctggagaggacgaaaactaagaaataccaaaagggagtgacaactgtcattccctttttcaagtgagaggttatatgaaattattatttgtttcactcggatgtgataaaaatctggtagattccgagtacatgatcggtatgcttaccagtcatggaattgaactgacggatgatgaaacggaagcggatatcattattgtcaacagctgctgttttatcggcgatgcaaaagaagaaagcattaacaccattctggaaatggcagagcagaaaaaaacaggctgctgtaaatcactcattgtcaccggctgcctgacacagcgttatcaggatgaagtgaaaaaagaaataccggaagtagatgctattttaggaaccaattcctatgattccattgtagaggcactcgaggagaccctgcagcataaattttataaaaattttcatacgctcagcggactgccgcagctgtcgaccaaacggacggttacgacaggcggacattatgcatatctgaaaattgcagagggatgcaacaaaaactgcacctactgtgtgatcccgtctgtgcgcggacgttaccgcagtgttccgatggacgagctggttacgtcagcagaagaactggttgtaggaggcgtaaaggaactgatccttgttgcgcaggagacaacgctttacggtgtggatctgtatgggaaaaaatgcctgcatgaattgttagaccgcctgaacgggatttccggtctgttctggattcgtattatgtactgttatccggaggaaatctatgaggaactgatcgattccatgattaaggataaaaaggtctgtcactatctggacatgccggtccagcactgcaacgatacaattttgcagcgcatgggaagaaaaacaaataaaaaggaactgatcgagagaatccattatttgagaaaacgtgtcccggatatcactttgcggacctctttgatctgcggattcccgggggagacaaaagagcagcacgaagaactgatgcagtttgtcaatgatatggaatttgaccgtctcggagcgtttacttattccgcggaggaaggaacaccggcagcggaaatgccggatcaggtgccgcaggaacaaaaagaggaatggcagacagacgtcatggaacttcaggaagaagtgatttttgacaagaatgaagccatgaaaggtacagttttgtatgcgtttattgaaggacaggttgcggatgaaaacaatacctacgtcggcagaacctaccgggatgcgccaaatgtagacggatatatttttatcaatacagacgaagaacttttaaccggagatattgtgaaggtggaagttaccggtgcatatgaatatgacctgatcgctacgattgtaaaataggaggaacaattatgaatttaccaaataaattaacaactttccgtgtgattcttattccgttttttgtatttttcctgttagctccatactttgaaggatacggaaattacattgcgcttgttatttttattgtcgcaagcctgacggattttctggatggaaaaattgcaagaaagtacaatcttgtaacaaatttcggaaagtttatggacccgctggcagacaagcttctggtctgctctgcactgatctgtctgattgcacttgacagaattccggcatggattgtgattgtgattatttcccgcgagtttattatcagcggattccgtctgattgctgcagacaatggtgtagtgatcgctgcaagctactggggcaagtttaaaaccgcatcccagatggtcaccgtgattcttctggtactgaatattcaaaatacggtatttacagtactcggaacggtatttatttatatttccctggtacttaccgtcgtatctctgattgattatatcgcaaaaaacaaagaagtattaaaggatcagaactaatgaaaattgacagacttctggcagaacaccagctgctggtgacgacagccgagagctgtaccggaggactggtagcgtctgcactggtagatattccgggaatttccgattattttaaagagggatatatcacttatgctcccgaagcaaaagaaaagatactgggagtattgccggagaccatttccgattatggtgtcgtgagtgaacagaccgcacaggagatggcggaaggtgctgcaaaacaggcacatgcgggatgtgcggtggctacaacgggggttgccggacccgggggaggaactttaaagactccggtgggaacggtctgttttggatgttttgtgcagggaaagatattttccgggacagaacattttaccggtacaagaagtgaaataagacatgcggctgcggcatatgccattgcatttctggagcggtgtatcatcaaaacatatggaggaaccttatgcgaatcatagcaggaacagcgcgcagcctgccgctgaaaacaattgaggggctggaaacgcgcccgacaacagacaagatcaaagagacattattcaatatgctgcagaatgatgtgccgggatgttatttcctggatctgtttgcgggcagcggtcagatcgggttagaagcaatcagccgcggagctttgtatgcggtttttattgagaataaccggaaagcggccaaatgcattgaagataatattgcattcacaaaatttacgaaggaatccagactgcttaccacggatgtgatcagcggaatcagcagtctggagggaaaatatacatttgatattatttttatggacccgccataccggcagggacttgaagaagatgtgctgcgtttcctttcaaaatcaagtgtgttgaaacctgacaccatgattattgtggaagcatcgctggatacggatttttcttatctggatgagctgggattttccgtgataaagttcaaaaaatataagacaaacatgcatgtctttattcaacagaagagggtataacaaatgaaaaaagcaatttatccgggaagttttgatccactgacattcggacatatggacatcatcaaccgtgcttcaagaattgtggatgagctggtcgtcggagtgctcaacaacagcgcaaaaaattcgttgttttctttagaagaacgtgttagtatgatagaagagatgacaaaggatattccaaacgttacggtggcgtcctttgatggtctgttggtagagtttatgaataaaatagatgctaccattatcgtgcgtgggcttcgtgcagtgacagattttgagtacgagctgcagatcgcacaggcgaaccatgtgcaggattctaatattgaaaccattttcctgacaagtgatctttcttattcctatttaagttcgacaattgtcaaggaatttgcgtcctacggtggagatatttccaactttgtaccggaacgttttattgaacggatttataagaaatatgagaacagataggagagattttcactatgagcagtaagatggaacagattattgaggaaatcgaagagtatattgatggctgtaaattccagccgctctcaagtacaaagattattgtcaacaaagaagaattagaagaacttattgcggaacttcgcgccaaaacaccggaagaagtaaagcgttatcagaagattatcagcaataaggaagcaattttagcagatgcacaggcgaaggcggatcagatcattgcacaggcacaggtgcagaccaacgaacttgtcagcgagcatcagattatgcagcaggcatatgcacaggcaaatgaagttgttatgatcgcaaccaagcaggcccaggaaattttagacaatgctaccaatgaggcaaacagtctgcgtgtcagtgccatgggatatgcggatgaccagctgcatgagatcgaggaggttttgtcgaattccatcgagacttctcaggcgcggtatgacagtctgatttcttcactgcagggtttccttgatgtagtgacaaagaaccgggcacagctgtttccacagacagaagcagcagaggaggcagccgcttctgccggacaggcagcagagtctgcagaggagccgcagattaccaatatttcagcttcagatgaggatgcccaggaagagtaaaggaatacagcatccaacggttaacagtaagaggattattttctgtaatacatagttccggagcgagaggccggtctggtgaaggatggaagagacctgaaaaatgccggacaatcctccccatgacaggaataacactgccagaagagattttatctgtctggtgcaggcagaggtggaaagcagcgcaacaccgtttgtaacttctaagaatccggtggcggccagcgaaaaccaatgcgccggaaacggcagtgtctgcagcatttcgcagaaaatggaaaacaggatgatatagccgcatattttgatcagggtttcaaatccgtgaatgatgccggcatcaatgatttgcatatccatatgaaatcttgatgccgtttctttttgtgtagaagaaggggttctgtgatataataacagcacactcattccatacaaaaacggaatgccatagatcagaaaaacgtatacaggagataacggaagctgcaaaatttcctgaatggcggttatgacaaatacgggacttaagttgtttgtaaagcagcataaggcagaggctttttcccgggagatatagttactgctgtaaaagtcggcagtcagtttgcagccgatgggaaatccaaacaaaaaaccacacagtacgatgtagcaggcagaaaatcttttcggaagaatttcactgcgcagaatgacatatgagaggacacaaaaaggaagcagcgttggaagaatctgcgtaaaccacagccgcagcccttgttttgatgccgaaactgctgcgtgggggaaacagataaaaaacaaaaacagtatgcaacagagaagagtaaatacaaattttttcatgatacagtttatgtgagacaggaggagtatatgagtacattagagcatttatatccggaaagggtattttattatttcaagcagatcgcagcaattccacatggatcgggaaacaccaaagcgatcagtgattacctggtaaaatttgcaaaagaacacgcactgacctggtatcaggatgaagcaaacaatgtggttcttgtcaaggaagcatccaaaggctatgaaaaggctccggcgatcatcattcagggacacatggatatggtctgtgaaaaagaaaaagactgtaatcttgacatggataaagaagggctgcgcctgtatgtagatggagatttcctgaaggcagaagggacaacgcttggcggagatgacggaattgcagtggcatatgcgctggcaattttggaatcagatgaaatttcccatccgaaattggaagttgtgattaccgtggatgaagaaatcggaatgcttggggcggctgtcatggatctgtctatgctgaccggacataccatgttaaatattgacagtgatgaagaggggattttcctgaccggctgtgcgggcggtatggcattaaatgtttccattcccgtaacccgtgtcagacagacgggaaagaaactttctcttattgtgaccgggctttccggcggacattccggcagtgagatcgataaagaacatggaaatgcagatcttttgatgggacgcctgttgtatggaatcttttcgcgttccccgtttggaatccttactttgcatggagggttaaaggacaatgcgattccaagagaatgcgaggcagaaatcctgattccgaaagaaaatacgcagattgtctgtgaatatgtaaaagaactgaatgaaatattaaaaaaagaactggtggaaacagatccgggcgtgcaggtgctgatagaagaacagggcaatgctgaagcggaaatattagattatcattcggtaagccgtgtgattttttatctgcgcaatgtgccaaacggaattcagcatatgagccagctgttaaacggtcaggtagaaacttccttaaatcttggaattctggaattaaaagaagatgccttgacgtctcttacttcgatccgaagcagtgtaaaaacccgcaaagaagatctgtgtgcacgtgttacgatgcttgtggagatgcttggaggagaagcagaagtggaaggtgattatccggcgtgggagtatcgcacggattctgcgttgcgtccgcaggtagaaaaagtatacgaagagctgtttcataaaaaacctgtattttccacgattcatgcagggctggagtgtggccttctttctgaaaaaattccggatctcgactgcgtttctttcggaccggacaattttgacattcacacgccaaaagagcatttatccatttcttctaccgcaagagtatgggatttcctagttgcatttctgcagcaggcaaacgtatgattcgcctggacaaattcctggcggattccggcgtcggcacacgcaccgatgtgaaaaaacgaatccgcgagggacgaattacggtaaatgatgcggtggcaaagaaaccggatcttaaggttgatccggaacaggatcagattctgtttgatcatcgtccggtgatttatgagaagtattcctattatctctttcataaaccggcgggctgtgtgacggcaagatgtgaccggttaaaccggacggttatggatttcttcccggagtccatgcgaaaagagtttgcaccggtcggaagactggataaggatacggaaggttttttgctgattacaaatgacggagaactcacgcatcgcctgctgtcaccggcataccatgtcaaaaaaacgtattttgtacaggtagatcagaaaattccggatacgacggcaggacaatttgcagagggcgtggacatcggcgatgagaagcgcacacttccggcagatctcaaaatccttggggaccgtgaggcggaacttacgatttcggaaggcagatttcaccaggtgaagcgtatgtttgcgtcggttggatgtaaggtgacatatctgaaacggatctccatgggaacacttacacttggaacattagaaaaagcaacttaccgtaaacttacggaacaggaactggcttccctgaaaaaagaagcggaaaataaacaatcatcaggagtataaaattatgtacgaaggatatctgccgatttcaaaacaggatatgcaggaacgcgggattaaacagctggattttgtatatgtgtgcggagacgcatatgtagatcatccgtcttttggtcatgcaatcattgccagactgctggaggcacatggctatacggtgggaatcattgcgcagccggactggaaggatgatgcttctatttccgtgcttggcgttccaagacttggctttttggtttctgccggaaatatggattctatggtgaatcattattcggtatccaaaaaacgccgtgcaaccgattcctataccccgggaggcgtaatgggaaagcgaccggattatgctaccgtggtgtactgtaatctgatccggcatacatacaagaagaccccgatcattatcggtggaatcgaagccagtctgcgccgtctggcacattatgattactggtccaacaaggtgaaacgttcgatcctgcttgattccggtgcagatctgatttcttatggaatgggagaacacagtatcattgaaatcgcagatgcattgaatgccggaatcgatgtgcatgatattacctttattgacggaaccgtatttaaaacaaaaaaccgtgatctgatctatgatgccatcgagttaccggattatgatgagatcaaagaaaataagcgttcgtttgcgcagagtttttataagcagtactgtaatacagatccattttccggaaagcgcctgtttgagccttacggtggaaccacatttgttgtgcagaatccaccggcaaagccattgacacagacggaaatggatgaagtctatgcacttccgtatatgcggaattatcatccgtcatatgaaaaagacggaggggttcctgcgatccgggagattaagttttccctgatcagcaaccgcggatgttttggaggatgcagtttctgtgcgctgacgtttcatcagggcagaattatccagacgagaagccatgagtcgatcattgacgaggcaaaacagatcattcaggaaccggacttcaaagggtatatccatgatgtcgggggacctacggcgaatttccgtgcaccggcatgcaaaaagcagatgacgaagggagcctgtccgacgaaacagtgcctgttcccaaaaccatgtaagaatctggaagtagaccataaggattacattgccctgctgaaaaagctgcgggtgcttccgggtgtgaaaaaagtatttatccgttcgggtatccggtttgattatctgatgtatgataaggatcgtacatttttgcgggaactgtgcgagcatcatgtgagcgggcagttgaaggtggcaccggaacatatcagcaataccgttttacagaaactgggaaagccaagtgtggaagtatataacagttttgtaaaagcgtataaagatatgaataaaaaaatcggaaaagagcagtatcttgtgccgtatctgatgtcttcccatccgggatcgacgctgaaagaagcggttgaactggcagagtatctgcgggatttaggttacatgccggaacaggtacaggatttttatccgacaccgtcaacgatttctacctgcatgtattatacaggactggacccgcggacgatggaacctgtatatgtggcaaccaatccgcatgaaaaagccatgcagcgtgcactgatccagtatcgcaacccgaaaaattacgatctggtacatgaagcattaatcaaagcaggacgtcaggatctgatcggatttgattccaaatgtctgatccgtccacgccggccgaaaaaagacgcgggtacttcctaccggtcatccagacagggaaagaaggcaccggcaggcaaggctgctgccggaaagatggtgaccgcaaaacacaaaaagaaaaccatccgcaacatccataaaaagaagtaggaaacgttatgaaaacatttaccatcggcacgaatgatgccaaccagcggtttgataaatatttaaaaaaactgctgcccaatgcatcggtcagttttttatataagatgcttcgaaaaaagaatattactttggacggaaaaaaagcgaccgggaaggagacgctgcaaaaaggcgcgcaggtagcggtgtttttcagtgatgaaacactgcataaatttatgcaggatacaaaaaaactgcaggaagagtttcacatgctgcagcgtctgccaatgaaggggctttccatcatttatgaagatacggatattctcatcgcggataagccatacaatatgctttcccagaaagcaaaagaacaggatctgtcggccaatgaatatctgctcggctatctgatccggagcggggcactttctctggagacattcggcacgtttcgtccgtcagtgtgcaaccggctggaccgcaatacgacaggacttcttctgatgggtaaaacgcttgccggcgcgcagatgctttccgaggggctgcgggaacgtaccattcataaattttaccgtgccattgtatccgggaacgttacaaaaccggtacatctgtccggatggcttatcaaagacgaacataccaatcaggtaaagattctgacacaggaacaaaaagatgctgtacggattgagacttcttatacgtccgtacaggcgaaaggaacatgcagtctgttggaaatctgcctgattaccggaaaaacacatcagattcgtgcacatctggcatctgtcggtcatccggttatcggagatcgcaagtatggggacccgtcagtgaatcacaaattttatggtacctttcatgtggatcatcagctgcttcatgcgtatcgtctggaatttccggacggaagagtttttactgctccgatgcccgaaatatttaaagaaattatagaaaaggagtgtggatagcagatgccgacctggaattcaaggggactgcgcggatcaacactggaggatcttttaaaccgtacaaacgaaaaatatgcacacaacggtctggcgctgatccagaagatcccgacaccgattactcctattaatattgataaagaaaccagacacatcacacttgcctattttgaacagaaaagtaccgtggattatattggagctgtacagggaattccggtgtgtttcgatgcaaaagaatgcaacaccgacacctttccgcttgccaatgttcatccgcatcaggtggcttttatggagcagtttgaaaagcaggagggaatagcgtttcttctgatatcttttacgcacagggaggaattttattatctgcgtttttccgatctggagaagttctggaaccgggctctggatggtggacggaaaagctttcggtatgaggagctgaatccggcctattttctgccaaaggtatcaggggtactgattccctatcttcaggttctccagaaggatttagaggacagggattgacaatctttggaatatttcttataatagcgttgtttcatgtgctaccaaattatcacggtatcactttaaaatagtaaagcgagaggttcgattatgacagaccagatgttacatacgccggacggagtccgggatatttataacggagagtgcaaacagaaactactgttgcaggagagattacacgatgtattgcgtcaatatggatatcgtgatattcagacaccgacgtttgaattttttaatatttttggaaaagaaatcggtacaacaccatccaaagatctgtataagttttttgacaaggacggaagcacgctggtacttcgtccggattttactccatctattgcaagaagtgctgcaaagtactataccgaggatgatatgccggtaaaactttgttatatgggaaacacgtttatcaattccaacgcgtatcagggacgattaaaggaaacgacacagtgcggtgcggagctgatcggagacggaacggttgccgctgacgcagaaatacttgccatggtagtggagtcccttctttcgagcggactgaaagaatttcagatctcggtgggacatgcacagtttttccgcgggctggcagaggcggcaggacttgatgaggaacagcagcaggaattaagagaactgcttgccaataaaaattatttcggtgtggaagaaatggtagagggaatgcatttaaatgacacgttaaagaaactgttttcccttctcggaagttttgagacacaggtagaagaacttgctgaggcaaagtctcttgcttcggattacccgaacattctttccgcaattactgatctggaaaaactcggatcgtttctgcggttatacggaattgaaaaatacgtttcgtttgaactcggaatcatcagcaattaccattattataccggtattatttttgcaggatatacgtttggaacaggagaacctgtggtaaagggaggacgctatgacaggctgcttacatatttcggaagaaaagcaccggccattggttttgccattgttgtggaccagcttctttccgctctttccagacaaaagatcacacttccgtccgaggagaaaaatcagatgatcgtttacgcggaaaataagattgcggaagcagtagaaaaagcgaaagaacttcgcgctcagggaatttcggtttctctgatccagatgcaggaaggccggagcaaagatgattatctgagctatgccatgaaggatcacgtttcaaaagtagaatttatagaggaagcataggaggagatcatggaagaaaagagatatctgacgtttgcactgggaaagggacgtctggcaaaaaagacactcgaactgtttgaaaaaataggaatcacctgtgatgagatccgtgatccggatacccgtaaactgatctttgtcaatgaggaacttggacttcggtttttccttgccaagggaccggatgtgcctacatatgtagagtatggtgcagccgatattggaattgtcggaaaagacacgattttagaagagtcgagaaatatttatgaagtgctggatcttggattcggaaaatgcaaaatgtgcatctgtgggccggaaagtgccgcggaacttttgcagcatcatgaacagatccgtgtggcaaccaagtatccgcggattgccaaagattatttttataacaaaaaacatcagacggttgagattatcaagctgaatggttccatcgaacttgcaccgatcgttggactatcagaggtaatctgtgatatagtagagacaggtacgaccttgcgtgaaaacgggctgacggtgttagaggaagtttgtccgctttctgcacgcgtggtcgtaaaccaggtaagtatgaaaatggaaaatgaacgaatcacaaaactgatccgcgatttgaaaaaagtcatttaggagggacatcatgagaattttaaaacttacagaggataccagaaaagatattctgcagaatctcttaaaaagaagcccgaataattacggtgagtttgaaggccgtgtaaacgccattattgaagaagtgcgaaataaccgcgatcaggcagtttttaattataccaagcagtttgacggcgcggacatcaatgccggcaatattcttgtaacagaagaagagattgccgaggcctatgagcaggttgacacgacattgcttgcagtgatccgcaagtctcttgtaaatatcaaaaaatatcatgaaaaacaggtacagaattcctggtttacgacagaggacggtatcattcttggacagaaagttaccgcacttgcgacggttggtgtctatgttccgggcggaaaggccgtgtatccttcttccgtactgatgaatgttcttccggcaaaagttgcgggagtagaccgtattgtaatgtgtacgccaccaggcaaagatggaaaagtatatccttccactctggttgcagccaaagaagcaggggtggatgagatctataaagtcggtggagcacaggcaattgctgccatggcatttggaaccgaaagtgtgccaaaggttgacaagattgtcggaccgggaaatatttatgtagcacttgccaaaaaagcagtgtttggttatgtcagcattgattccattgcaggaccgagtgagattttagtgcttgcggatgagactgcaaatccacgctatgttgcagcggatctgttatcccaggcagaacacgatgagatggcatctgcaattctgatcaccacaagccagaaacttgcagaagaagtatctgcagagattgatcagtttgtcgcagaactttccagaaaagagatcatccagaagtccctggacaattacggatatattcttgtggcagataatatggaagaagcaattgataccgtaaatgcgattgcatccgaacatatggaaatcgtcacagcagatccgttccacgtaatgacaaagatccgcaatgccggtgctatctttatcggagagtattcctccgagccgcttggcgattactttgccggaccaaaccatgttcttccgacaaacggaacggccaagttcttttccgcactttccgtggatgattttattaaaaagtccagcattatttcttactcacgggaagcgcttgaaaaagtacataaagatattgagcagtttgcagaatgtgagaaactgaccgcacatgcaaactccatccgcgttcggtttgagtagtatatgggaaagaaagtctaaaaggagcagattatggaaaaaagagagagcagcacaacacgcaaaacaaaagagacggacattcaggtgactttaaatctggatggaagcggtatttcccatattgagacaggcattggattttttgatcatatgctggagggattttccaagcacggtttcttcgatctgcatatggaatgtgatggagatcttcaggtcgacagccatcatacgatcgaagactgcggaatcgtacttggagatgcgatcaaaaaggcattgggggacaaaagcggaatcaaacgatttggaagctgtatccttccgatggatgagacacttgttttgtgtgcggtagatctatccggacgtccatatcttgtatttgacggcgaatttactacggagcgcctgggaacacttgataccgaaatgatccgtgaatttttctatgcggtctcctacagtgcgggcatgaatctgcacattaaagtgttaagccccggaaataaccatcatatggcagaagcgatgtttaaggcatttgccagagctttggatgaagcggtttcccatgatccgagagtaaaaggaattctgtcaacgaaaggaagtttgtaatacatgaaacaaaaaaacattgtcgcgacgctttatttaaaagatggtcatgcagtaagatccatgaccgattttacgccggtagatgcgaatgtttatcgactgtgccagttatacaacgacagtggagttgacaagatcattatttttgacctgtctaccagcgatgatgagcatgaaaagaatgtcaatacgattcgaaacatcaatcgcaacattgatattaaagtatgcgcaggaggaaacattaaccgtctggaagacatcaaaaaacttttgtttgcgggatgccttcaggtgattttgaatgcttctaagccttcgagcatcggactggcggaggaagccagtgcacgttttggcaaagaccggattctgctctctatcaacaatgtggattttatttttaagaatcaggattcgattgaaaatacattccatgaagcactggtgttaaatccggaaattctggatgcactggaaaatctgaccaacattccgtatgtggtggaacttccggattataattttgacgagatcgtaaggctgctaaagcgggaaaaaatccgaggaattgcgggtccgttcatcaatgatacttcaacggatattatgaagttaaagtcttctctgcttcaggaaggcatcaatatgtataattttgcaccggatctgtcctgggaggatctgaaactgaattcggacggaatggttccggtcattgtgcaggattaccgtacagatgaagtgctgatgcttgcatacatgaacaaagaggcgtttgatacgacaattaatctcgggaaaatgacctactggagcagaagccgtgatgaactctggaccaaaggcctgacatccgggcatttccagtatgtgaaatccctgacggctgactgcgactttgatacgattctggcaaaagtctcccaggtaggggctgcctgtcacaccggaaaccgtacctgttttttcaatagcatcgtacaaaaagagtatgttgagaaaaatccgctgaaggtacttgagagcgtgtatgatattatcaaggaacgtaaagcacatccgcaggatggttcctataccaattatctgtttgggaaaggaaccgataagatattgcagaaacttggggaagagtgtacggaaattgtaattgcagcgaaaaatccggaaccggaaaacatcaaatacgagatttccgattttctgtatcactgtatggtgcttatggtggaaaaaggcattacctgggaagagattgccaatgaacttgcccagcgataaaaaataaatgttaagaggtatctatgagaaaactagctttaagtgacgagattctgatgcagattgaaaaacctgcacgctatatcggtaatgagctgaattctgtagaaaaagatgacacatcgcagattcgttttgcgatgtgttttcctgatgtatacgaaattggtatgtcacatcttggaattcagatcctatacgacatgtttaaccgcagagaggacacctggtgtgaacgtgtctattccccatggccggatctgcataaaattatgaagaagcagaatattccgctgttcggacttgagtcccaggaaccgatcaaaaactttgattttgtcggtctgactctgcagtatgagatgtgctacaccaatattttacagattctggatctggcacagattccgcttctttcggctgaccgtggggacgaagacccgattgttttaggtggaggaccatgttcttataatccggaaccgattgcagacttttttgattgtttttatattggagaaggggagacacagtatgatacatttttaaatctctataagtcgatgcgggcatccggacagtattccagaaaggcatttctgcatgaggcggcaaaaatagagggcatttatgtcccgtcgctgtatgaagtccgttacaaagaagatggcacgatagcggcatttactcctgtttatgatgatattccggcatccatcaaaaagcaggtggatatggatctgaccggctcggtttatccggaaaaaccggtggttccatttatcaaagcaacacaggatcgcgtggtgcttgaaatacagaggggctgtatccgcggatgccgtttctgtcaggccggcatgatttaccggccaaaccgggaaaagggcgtaaaacgactgaaagaacttgcacaaaccatgcttgcatcgaccggctatgaagagatttccttaagttctctcagttcatcggattattccgatctggaggaattgatcaatttcctgattgaggagtgtgacaaaaaacatgtcaatatttccctgccatcccttcgtattgatgccttttcccttgatattatgcagaaagtgcaggacatcaaaaaaagcagtctgacatttgccccggaggcaggttcccagagactgcgaaatgtcatcaataaaggcctgacggttgacaatattctgaccggttcccatgatgcgtttgtcggcggctggaataaggtcaagctttattttatgcttggacttccaacggaaacagaagaagatatgcgggcgatcccggaactggcaaacgagattgccgctttgtattatgacaccgtgccaaaggaacagagaaacggaaaatgccagattacgatcagtacttccttttttgtaccgaaaccttttaccccgttccagtgggctaccatgttagacccatcagattatctggcgcgtgcaaagattgtcaatgatcatgtaaaggaacagttaaaccacaagagtatccgttacaactggcatgaagccgatgtgacggtattggaaggaatccttgcgcgcggagaccgtaagatttcaaaagctattctttatgtgtatgaacacggcgaatttttcgatgcgtggtcggaattctttcactatgatctgtggctggaggcatttgctgcatgtggcattgatattgatttttataccaagagagcacgaagcgacgatgaaatttttccgtgggattttattgatgtcggtgtgacaaaggcatttatgctgcgtgaatggaaaaccgcgctcagtgagacggtgacgccaaactgccggatgcgctgctccggatgtggtgcaagacaatttggaggaggtgtctgctttgaaaatcagaattaaatttcgaaaatggggtgtcatgaaattcatcggacacctggatatgatgcgctattttcagaaagcggtccggcgtgcaaagattgatatccgttattcggaaggatattctccgcatcagattatgtcctttgcggcgccgcttggagtcggaatcacaagcgagggcgaatattttgatattgaagtcaatgaatccatgacatctaaggaggcagtcgctgcactgaatgaaaccatggtagatggtgtggaggttacttcctatgtgaaactgccggataaagcaaaaaccgcgatgtcaattgtggcagcagcggattaccggctgagctataaagaagggtacgaaagtccgttttcaacggaagaatggaaaagaatcgtcaaagaacggtttttggacagcccacagtttaccattatcaaaaagacgaaaaaaagtgaacgggaagtggacctaaaaccattggtatacgcgttttccgttgaagaggagcagggacgcccggcatttttcctgcaggtttctacgggcagtgtggataatatcaaaccggaactggtactttcatcgatttatcagctttgtggactggaatactgcgaatctgcaatccagatccaccggctcgaagtttatgcgagggatgaacaggggcagctagttgggctttccggcatgggagaggaaattgtttaaatgaatcggatcgttgtcacaaaactggaacatcatcagacagagtatcttgcttatctggttttggatgagaaccggaagctacaggaacttcaggtttttgaaccggaagaaaatactctgctggatcatatttatgtaggatatgtagagaagattgtgcccaatattcatgccgcttttgtgcgcattgcggatggacagaaatgctatcttccgctgaatgatgtgaaaaacccggtgtataccagaaaattatccaaaaaagaagcgctctgtgaaggggatgagttgctggtgcaggttgtaaaagatgcggtaaaaaccaaagatccggttgtaagcaccaagcttgtagtgcatggacattactgtttcctttcgacagagaatacctgtcttggcgtttctaaaaaattatcccaggaggagtcaaaaagactgtcggctcttttagagaacacgtgtaaggatcatgaagcagaagggtacgggctggtattcagaaccaatgcaggggcggttccggaaaccgaattatgcgaagatatcgagctggtgcagaaagaataccgggctttaaagaagaccggtacacatcagaacgccggagatctggtgtaccggaatctccccggctatctggcgcggttaaaagcagaaaattttgaaaaaacagatctggttcttacggatggtcaggatctgtatcaggagatctgtgcataccttccccatcttgtggaagaaaagaaagtgcagctttatcgggatgatgcggtcagtctttcgactttatatcatctgcggggcaatatgcaggaactgctttcttccaaagtatggcttgattccggagccaatattatcattgaatctcttgaaaccctgacggtcattgatgtcaacagcggaaaaaaccggtcccgccgggaagaggctttatttgcgatcaatgttgaagcggcaaaagagattgcacggcagcttcgtctgcgcaacatttcagggatgatcctcgtggatttcatcaatctgaaaaagaaagaacagcagcagaagctgatttccgttattcgggaggaattacaaaaagattcggttcccgcaaattttatcgatattaccagacttggtctggtggaactgacccggaaaaaagtatacaaatctttgcgtgaaattttatcataaacagcttgacgaacaggtggtcatgtgctattatacactagtatgccgcacagtgaggtaaaagtttgcttattggcaacaccgtaactggcgagtaatgataaataggaggtgccatatgtacgcaattatagcaacaggtggtaaacagtacaaagtatccgaaggcgatatcattaccattgaaaagcttggagttgatgctggtgagaaggttacttttgatcaggtattagcagtatccggagacgatatgaaggttggaaacccaacagtagccggagcaactgttgaagcttctgtcatcaaagaaggcagagcaaagaaagtaatcgtttacaagtacaagagaaaaaccggttatcacaagaagaacggacacagacagtcgttcacccaggttaagattgaaaagattaatggataatcgataggaattgttatatgattactataacgattttacaggatcatgaagatgcagtgggatttcactgcatcggtcattccggatatgcggaagcaggaagtgatattatctgcgcaggtgtttcggcacttgtgataaatacgatcaattccatagagactttcacagaggattcttatcatattgatacagaagagacatccgggctgattgatttcagacttgatcagaaagccggtcacgatacacagcttctgatgaagtccatggttctgggcttacaaggaatacaaaatgattatgggaatgagtatatcattcttgatttcaaggaggtgtaggacatgttgaatatgaaccttcagttttttgctcataaaaagggagttggttctacaaagaacggccgtgattccgagtccaagagattaggagcaaagagagcagacggacagttcgtaaaggctggcaatattctctatagacagcgtggtacaagaattcatccaggtgtgaatgttggtatcggtggagacgacacattatttgctaaagtagatggtgttcttcgtttcgagagagtaggaagagataagaagcaggcttctgtatatccagtagacaacgagtagtttacaaaaccccgactttttgagccggggttttatcgttatgtaggagagagattatgtttgcagaccgtgcaaaaattattatcaaatcaggaaaaggcggagacggacatgtgtccttccgtcgtgaaaaatatgtgccgaacggtggtccggacggtggcgatggaggaaaaggcggagatgtcattttcttagtagacgagggaatcaatacgcttgcagactatcggcacagacgaaaattcgcagcagaaccgggcgaagaaggtggcaagaaaaactgccatggaaaaaatggtgcagatctgatattaaaagttccggagggaacaattataagagatgcggcatccggaaaagtaattgccgatatgtcaggggaaaataagcgttctgtcattttgcatggcggccgtggaggacttggcaatcagcactttgcaacttccaccatgcaggctccaaaatatgcgcagccgggacaggaagccatcgagattgaagttcagctggaacttaaagtgatcgcggatgtgggactggttggtttcccgaatgtcggaaaatccacctttttatcgcgtgtgaccaatgcacagccaaagatcgccaattaccattttacgacattacagccaaatctgggtgttgttgacatggaagacggaaacggttttgtgattgcggatattccgggactgattgaaggtgcttccgatggtgtcggtctgggacatgaatttctccggcatattgaaagaaccaaagtcattatccatattgtggatgcggccggaaccgaaggacgtgatccaattgcggatattcatgccattaaccgggaactggatgcatataatccggacttgttgaagaaaccacaggtaattgcagcaaacaagattgatgcaatttatggcaatgaaaacgaaattatttctgcgcttcgcgcagaatttgaggaaaaagaaggcattaaagtgtatccgatttctgcggtgagcggtcagggtgttcgggaattactgtttcatgtacgtgaacttctggcaaaatgtccgaaggaagccgttgtctatgagcaggaatttgatccggcacttggcttctttaaggatgaaccatatacaattacccgtgcagaagacggtgcctttgttgtagagggtccaaagattgaaaaaatgcttggatatacaaacatggattccgaaaaaggatttttattcttccagaaattccttcgggaacagggcatcttaaaggaactggaagaacagggcatacaggatggagatactgtccgtatgtattataacgaatttgattattataagtaacaggaggaaacgctatgaacagcagacagcgcgcctatctgggaagccttgccaacaatatagatccgatctttcagattggaaaagcatctctgacaccggagatcattgaagcacttgatgccgcattggaaaagagagaactgattaaagtctctgtattgaaaaactgtattgatgatccgaaggagatcgcttctgtcattgcagagcgtacacattccaatgtcgtaaaagtaatcggaaagaaaatgatcttttaccgcaaggcaaagaagaatccaaagattaaacttccagaataagacacatgaatatcggaatattaggagggtcttttgatccaattcataacggacatcttcatatggcaaaatgtgcatacgaatcttatgcactggatcaggtatggcttattcccgccggacactctccaaataaggatgagcatgggatgaccgatgccaaagaccggtttcaaatgtgtaaactggccgcacagccgtatccctggatgacggtcagccggttggagcttgacagtgccgagagaagctacacataccgcaccatggagaaattgtcggaacagtttccgatgcatcgtttcttctttattatgggtggagattctctggactattttgaacaatggaaacaaccggaacgaattgccaaactggctaccattctggtgatcccgagggatctttttaccatcgctgcactggagaagaagatccgtttgttgcaggaacaatttccctgtgatatccggatcgttccctgtgaacgttttttgatgtcttccacaaagatccgccaggcactgatgagaggagaacatccggaacatgcgtttccggaagaagtatctgcgtatattcgcaggcatcatctgtatcaatcgtaaagaagtggagcaaaacgtatggaacgagaagaaatacaaaagagattgaaaaaagaactggataaaaaccgctatgagcatacgcttggggtcatgtatacggcaggaagccttgccatggcatatggatatgattatgagaaggcgatgatcgcaggacttctgcatgattgcgccaaatgcctcccgacagagaaaaagatttctctctgtgaaaaaaacgatatcctgatttctaaagtagagcgtgaaaatccaggacttctccatgcaaaagcaggtatggttttggcagaggaagcatatggagtaaaggacccgcagatccttcatgccatcaaggtgcatacaaccggagagccggatatgaatacattggataagattatctacattgccgattatattgaacctttaagatgtgaagctccccatctttcgatcataagacagattgccttttcggatctgaatcagtgtatggcagaaatcttatatgatacgctgcattatttaagcgggagaaaaggcagtgtagacccaacgacccagttaacctatcaattttatgaaccgtatggaaaggatcagccatggaaacattagaaatcgtaaagaccgccgtagaagcgctcagagataaaaaggcagaggatgtaaccgttattgatattacaggagtttcctctatcgccgattattttattattgcaaacggaaacaaccagaatcagctgactgcaatgcaggatgctgtagatgaagcattatacaaagcagggctgcatgcaaagcagattgaaggaaataataagtcgacatggattctgatggactatgaggatatcattgtgcatctgttttccaaagaagaccgtctgttctatgatctcgaacgcatctggagagatggaaagatcattgagatgtaattccaacaggtattttgtgtaacagacatgattgattataaagagtgattataaatgaaaagtgagagaataacttctttcctacggatatgaaagggaagaaggttattctctttttttgtgacaaaataatatagcaggttataaatattaatagaacagataattagctaccgaatttccggagagtaataggaaactacgagatactcgccgctgtgcagtgtattatcttccgagattccgttcagttcgcacacctcatcgataaactgcgcacgggaggtacggtcagaggcagcatattgatcggcaagagaccacaaagaatctcccttttgtaattggacacttgcgtaatatttatgaaccggctgttcggctctggaaccggcaaatgtaataatactgtttccaatcagaataacggcgaagatgacaagaacacagaccagaacaatcacgcgtttctgggtctgaacggtatgttctcttcgggtgagactttcatttgcgcgaggtgagattttttcattatatacccttttcataataaattcctcctgttttatccgaaatcgaacatttgtttgcatgagataaatataatacacgaacatgcgtttgtcaatagagaatacgaacaaattttcggaatatacgtttgcgttctatgttgtagtatgataaactaagatcataaagaaatacgcccggaggtaacgcattatggcatatggaaaaatctcagataaacagagagaaattctggaatatataaaaaaagaaatcttaaacaaaggatatccgccaacagtccgtgacatttgtgaagcggtccatttaaagtccacatcatccgtccattcccacctggagacacttgagaaaaacggatatatccgtcgtgatccgacaaagccgcgtgcaatcgaaatcgtggatgataacttcaatctgacacggcgtgaagtggtgaatgtccctatgatcgggcaggtagccgccggtcagccgatgcttgccgttgagaatattgatgcctatttcccgattcctgcagagtatatgccaaatgcagagtcctttatgctgaaggtgaagggcgagagcatgatcaatgcaggtatttttgatggggacaatatcattgtggagcgctgtagtaccgcacagaatggggaaatggttgttgctttagtcgatgattccgcaacggtcaagactttttacaaagaagacgggcatatccggctgcagccggaaaatgatgcgatggacccgatcatagttccggactgtaagattctcggaaaagtgtttggggttttccggttattccggtaaaaataagcgtgcaagtcagtaggtagcgcatctttagattgattcaattgccattcagcaggatagcattagtaagcaaacagccgactttgctctagtaacatttgcgcagtcattaaaattaacagaaaatcaaaagaaagagttaattgagcttttgaatgagaaatatatggtttcagatattaagtctattgatgacattttatatcgtataaagtcagctatgtatgctaccaatgaagatgccaattattttaaggagcttgacactttagattcaccacaatcaatgaaattagattgagaatatgtctcccaggcattttaagtttctttttgaaattatagaataatttagcaattttgagagaatacagcaaaatctctaaaaatcagtgaaaatttgtgtcatttcaagacacgcagaaccagaaaatccgtattatttgatagaatatatatatcaaacctttaaaatatgattgaataccgaataagggatacaagtaccatgttaaaattattttatgttatatttatgaatctgcatcgtgcaccatatatgattcctagaatgcgggcagaagcagatcatccgcagcgctatacggaagaacagcgttattcgctcgtgcagcatgccatttatctgatgaacaagacgggaaaaattaacactatggagaccggtgcggaaaacctgccaaagcagggaggatacatgatgtatccgaaccatcagggcaaatatgatgtgttgggtattatgtatacccataagtctccatgttcttttgtgatggacaaacgcaagtcacatacgatacttgtacgggagttctgtgatcttgtgcaggccaagcgcctggaaaaagataatccgaggcagggaatcaccattatcaatcaggtagcaaaagaggtggctgccggaaaaaagtatattcttttcccagagggcggataccggtttaacaacaaaaataaggtatgcgattttaaggcaggaagttttaagattgctttaaaatcacgtgcaccgatcgttcccatagcactgattgattcgtataaggtgtttaatagttttcatatcgggccgatcacaacatatgtgcattatttaaaaccgatctgttatgaagagtataaaggaatgaaaacgcaggagattgccgatctggtaaaaatccggattgaagaaaaaatacaacaggaaatgcaggcacacaaataaaaaattcccggtatctttttttcaatggataccgggaattttaagttctgattacatatagtcatcatgatcagtttcggaattcccagagatattttctctggtatatacccgtttttgatctcgctgtatttcaaccagcgcagagagctgttcttttacatccatgacatttttgatatttttaatttcaaaatcgccaagggttttgtcggaagaatttacaagaatggttcccattccgaaaatccgctgagacaatgatctggtcacggtcagatcctgaatgcggtacagacggacttcatcctgccgctgatttaaaaaaccgctttttacatagaatctttcgttgtcataactgtacacagtgaaggtaagcggaagtccgcaccagattctttttcgttctttccataataagtccatttctttttgtcctccttatattttcatagaattttattttttctaaaaattttttacctcatttttgacctttttaaaaagatttttacgtttagtcttcacgaagatgaacatattttgcggcactgcggcgtctgtcctcttcaatggcagcataatgttttttggttgtattgacatctttatgaccaaggacatctgcaaccagataaatatcacctgtttcccggtaaagagaggtgccataggtgcttcgcagtttatgtggggtaatattctttaagtttgtgacaagttttgcgtatttctttacgagattttctactgcgcggactccgattcttcgtttctgcatagataaaaacagtgcgttttcatccccggaaaccggagtgatcagttttcgttcttccatatatccgcacagggcatttctgacttcctctccgaagtatacaacaacttctgcgccacctttccggtggatcttgattccattgttttttaaatcgacatcatccagatccagaccgacacattccgagacacggattcctgtcccaagcataagcgtcagaagggccaaatcacgtacttttgtgcggtcatggaacatttgttgctttttggttaaattttcgccagattcgacctcgtcaagcagattggcaacttcatccgcatctaacctgattatatttttgtcgtggattttcggggtacttactttggatgctggattcgactgtataaactcatttttgtacagatatttgtaaaaggagcggagagaggagagtttccgcttgattccccgttcctcgttggtatgtgccataccgtctttttcatatacttttaaattatacagatattcttccagatccatgggttttagattttccagaatactcagaggaatctccgtaatggtcatttttttacaaattgagttgttttcatgcagataatcaaaaaaacaggaaaggtcataggcataggcaagtcttgtccgcgactgggttttggattcgattgctataaaatactgtttgcaatagggtggaagagcagcaagctgctttcgcagttttaattcattatcaatatctactttttcgtaatatgctttttcattgttttccattgatattccacccttctattctgccggtgcatattgcatggaaaatgcgttttttgacaccggggttttctaaattaatctgccggacaagttgtttgacatattcacgtttggtttccccatctgccggacacggatttttcacaaggggaagataatatttatgaagaaatccgatgacatttgcttccggaacatacatcagtggccggatgacagtgattccgctgcggtctaaatgggtgacaggggcaaacgaataaaactgtccttcataaaacattgataaaaacatggtttctatgatatcgtccatgtgatgcgcataggcaactttattgcatccaatttgcctcgcatagtcatttaatgcgccttttcgcatttttgcacatagcgcgcatggagaactttcttttcgctcttcaaaaacaatttcgccaattttggttttgattacatgatattcgacatcgagcgttttacaaagctgccggatttcggacagatcataatgatcaaatcccagatcaacggtcaaagctgccaattcaaatttctttggataaaatctgcgtaatccggataatgcatataaaagtgtcagagaatcttttcctccggaaatgccgacggcaatccggtcaccatctgcaatcatctggtaatcgtcaattgcctggcggacataactgtataattgttgtagtttcatataatggttcctttgctttatgataaatcatttcttacgcggaaacagagtagagttcacccatataactattcgcaaaacctaagtttaacgaatagttctctcaagcaaaatcataatagcacaccgcgaacgctctggcaagccattatgcaagatcttcagaatccagcaatatggtaaaaggcccgtcgtttatcagagaaattttcatatctgcaccaaagattccggtttgtacatccggaatttcttctttgcattttgcaataatatattcgtagagattgtttgcaagttccggatttccggctttgataaaagatggacggtttcccttccggcagtccgcatataatgtaaactgtgatattaataacagggagccttcgatatcatgtaaagacaggtttgtttttccgttttcatcaccgaagatgcgcatcccaaggagttttcgaatcattttatcggcaatgtttttggtatcggtttctgcaattccgatcaggacgcaaaagccgtttgttatctgtccggtaatttcttgatcaacttcacatgttgcttcagtgacacgttgtattacaaatcgcatggatttcattcctcttaatattttcaatagatttttaaagtatacaagaaaaggaaccggaccttaagaccggttccttttttcagagcggaattgctttatttcttctgttccattttctttcgaaaatccagaataatgtcgacacacgcctccggtgtgatcttacttgtgttaagtgtcagatcatagcttctggagtctccccatttcttacaggtgtaataattataatagctggaacgctgcttatctcttttctggatcatatctttggcttttgattccgtgacatcctcacgtttgctgacacgcctgatacgatcgtccatatctgcatgtacaaagatgctcagacagtccggattagaagccagtgcgtaatctgcacagcggccgacaattacacaggactcctcggatgcaatcttttttatggtatcaaattgcgctaaaaataccttgtggttaagcggcatatccaaaaacggtgctgcagaataatttccaccggtatatgtatccattaccagggaatacaaaaaactattggttggacgctcatcatgattttcgaaaatttcttcacaaaagccagaatctttcgctgcctgtgccaaaagctctttatcatatagcctgattccaagacgttctgctaaaagttttgcaactgtgtatccaccacttccaagttctcttccgattgtataaatatgattacccatacccgttacctccgatgtcataaattctttaagtaatctcttaaagtatatacatattatacaacattcaggatctggatttcaacaattttagcaaattatcaaaatattccggcaaaggagcagaaaattccatatattctccactttttggatgaacgaatcctattgtttttgcgtggagcgtctgcccctgcaaatgtttgaacggtgatctgccactagaatacagagtatctccgagtaacggatgcccgatgcttgccatgtgtacacggatctggtgagttcgtccggtttccagttgaaactgcatataagtataatttccaaaacgttcaagaactttataatgagtaattgccggttttccgtttttctcattgacagccattttttttcggtcaaccggatgccttccaatcgcgccttcgatggttccctcatcttctgttacatttccgcagacaatgccaacgtagatgcggttgacggtatgttctttgatctgctctgcaatgtttacgtgactttcatcatttttgcatacaatcagggaaccggttgtatccatatcaatacgatgaacaatccccggacgtatctgtccgttgataccgctcagggaatctttgcaatgattcataatggcatttaccagtgtcccggaataatgtcctgccgatggatgaacgaccatccctttgggtttgttcacaatcagaacatcatcgtcttcatacagaatgtccagcggaatgttttccggttcaatggtcgtttcgacagcatccggaatggtgacacgtatgagatcttctgtatgtaccggataactggccttttgaactgccccgtttacctgaatttgtttgtttttgataagtttttgaaaaaaagaacgggagaaatccggataaatttcggaaagaactttatccagacgctccccttcctgtgtatactgtacttcaaatgattcttcctgcacggttttaggactccttttcgtcttgcaattttccagtgaaaatcaaagaaaaatcttcttccttgtaataaaaaagcacaacaatgatcaatgcgattgcagaaagtgttacataaatatctgcaacattaaaaaccggaaaattgatcaggctgaaataaaagaaatcaatgacatagtgatgaattacacggtcaatcaggtttccggccgcccctgcaaagattccgacggctatgatattcagcggaagaaaacggcggttcaatggaattcgctgatacacaatagccagtaaaacaagaacaacgatggtcagtacggcaaaaaagatcatttttgccatcaaaaaagcttccggatggctgtcaaaataagtaaaatgaaaaatccggtgcagaatagaaaccggatccagactaaatgcagcactgtcattctcgagatattttaactggaataccccatcgatcacagacacatccggtttctggtacagatgggtataggcaagccatttggtaaactggtcgatggcaattaaaagaataacaagcagaccgctgtatcccatatatttttttgtctttctctgattcattgttctctccttacttataaatcataaaccggacgcgaagttttccttttttgctgagagactggtcggtttcaaaaacaaaacgccctttttggcgaaccgaaacaatatctccgttgtcacaggattgattgcagtttgtaatgcagcgtccattaatgaaaactttctcagcggtaagatatgcggcagcttccgaccgggataaatggtatgcccgcgcaataatggcatcaatgcggttagaagcaaccatatcatcgtgttcctcaaaaacgggatggactttaagggtactgacatcttcgataatcgaacttcggatcatggtatggcggatctgcgtaaactgatccataataaaatctgagatggtctctgaacaaaagatataaatgtcattttccagcacaacaatatccccgattttactccggtccagtccaagatgcatcagtgcccccagtacatcgcgatgcgtaagtttttccgcatattttggatactggggaaccgcatggatacaaacaaacggataagaccattcataacaaagagcatcagggataaatgcaaccatctgacgctctgcctgctcatagccaccggatagttctgctgtagtatacagttccttctgcagactatgaaaaatattctgttcatttaaatttaaaaaatcactgaataatacaattcctttccggtccgcctgtctggaaagatccaaaagacgcttccggcataattcctgttcgttcatattattaatttaatcctggtaaatcaaaagattccataagtccctgaatatctccggaaatgtcaacaccatttggagttgcaaggaagatgtaattggagatcttctgtagatttccatgcatggcaaaggtagcaccggaagtaaaatcgatgatccgctgtgcaatatctacactgagtccttccatgttgattacaacggtacgtccatttaataaggtttctgttatttcaatctcatcttcaatggtagttggcttgatcacacatacttccattcccggttgtccctgtcggcggtttcggttgattggtgtaattttattctgctgcttctgcctctgcttttcggaaatatcaaaagttgctgcggtctgttgctgttcctcttcttttttgcgttctctacgggaaggttttttttcttttacctcataatcctcttcttcatcgtaatcgtaatcttcgttatcaaattcgtaatcatcatcatttaaacgcatgacatcgagaaatttatcaataatactcattttttaccaccttatttttgataatgtctttcgccgaaaattccggttccaacacgaaccatggttgcaccttcttcaattgcaaccatataatctccggtcattcccatggacaaaatatccatacgtacattatctatgttttgtgcgtcaatgtcaacagataattggcgaatctgccggaagtaagtgcggttgtcttccggattttccacgaatggtgcaatcgtcatcagcccaaggatttggatatgcggcaaagcggcaatctggcggataagggaaatggtttcttccttatgaataccaaatttactctcctcttctgcaatattgacctcgacaagaatcgagacggttacgttttgttttgccgcctgtttttcgatttcttttgccagatgcagactgtccaccgaatggatgagttctgtctttccaacgatatatttcactttgttcgtctgcagatgtccgatcatatgccagcggatattcttaggaagaacttccattttctcacacatttcctgaactttattctctccaaaatcacgtgcccccagatcatatacggtctgaagcatttcgattggcttggttttgctgacggcgatcaatgtcacatcactgcgttttcttcctgcgttttcgcatgccttgcatatatttgcttctacctgttgcaggttttcctgtaaatccatcatgtatacactccttttattttacaaccagctggttttcttttattttactgccgtctaaagcaatatgatcatacagggcgactccgtaagaagtgcctgtatcaacgatggtatatttattgttttgtgcaagaatatcaatttgtttaaatacggcatatcctttgttgatattataaacaccggtgagcttgtccacatcactgccgatggtatacgtcccggaagaattgttttttaccacaacatcgccggcagaaacggtttcatcatcaatatagtaaaaatcatccgtttcgtagtatatcgttggctgaaccagtgttaccgaaccggtatctccagcatggttttctatcataagtccgggatcggatgaatcgcctccctgtgtaaaatactcttttggaaccgtataaaactgtttttttgtaatggccgaattcggaattttcagaccggttttttcagatacgacaagttccacatcgacgaaacgatcatttacataacggatcattgccgtttttaaactcaggtttacataataacttccgtcttttttggtcagggaataagggactgtcagtgtaaaatcatccttgcagaaacggattttaatatactcattatcttttagctgttttgccatatcctctgatactggcaacagaatattccatttttcactgtcaatccgtttgtaggcaggggtatttgccgtgacctgttcctgatcatccagagaatttcttttgtaatctgccatgttaaactgattggcagtaaagttgtctgtggtgacactttcatagccgtccgtgtaatatacgataattccgggtttttctgacttctttttgtaaaacgtattgttttctacagcggctttcacatcttcatttaaagaactgagggcattcatactgagggtctgtgtcagctgtgcattgagttcgtttttgaatgtataaaccgaagaaaacgtgttggagtcataagaattccggaaaacatccagttcagaggaaacttcattcagtgtttcggtgtcaagggtgtcgccattggatgcgacatctgaaatctgtcgggaaagttctccgctggtatcaatggaatagaccacatcattgacggaggcttttgctccgtttttcagatagtaattgatataaccgctttgtcctgcatagacaaccgtctcatcgcgcagaatcagtccgtgataaacatggtttgttgcaatggttccctgccccacttcgtattcagcaaccgggctggaagtcagatacgatataaggttaaagatgacatagataattataattacaaaaatcacgattccgatatttaaattcagaccatgatgcattcgtacaacattctgtttgcgtgccaaaaaagtccacctctctgattgatacttctatcttaccattttcaaactgcaaatacaatcatcagaagaaatgtgtataattttaattttttgttccatactatggataaaaaatggaggtaagaaaaatgaaatggcttgataactgccttttgacattagcggtaattggatgtattgtttggggactgattggatttttccagtttaatctggtttcctttatctttggaaacggaacctggctgacgcgtgtcatatatgcgctggtaggactcagcggattatatctgatcagtttttatggaagaatccgttcctctctggaggattagacacaaaaaagatgggagtgttctcaataagaagcactcccatcttccgtaaaccgggatctcttagagcgaaaccgttactttcgcctgtgcatattccggcagatccgctttgtttttagaaacacttaaaataaaacggactttgtatttttcgctgataatatccagtttttcaatcgcccttaccatgtcctgatcggattcaatgaatgcaatggtaagaaaactgtccagatacatttcttccagatcgtgatcctgggatacaatcccacagataaaccctaaaaattcatcacagtttgtaattggataatccactacattgatcagacggactttattgtttaactcatacatatgtttctggcttttgtcaagataaacaacactcccggtaacggtactgacggtgtgattgactttttctaaaagttccttggtctttccttttcccttttccccacaaatgatttcaatcatggcacttcctcctgcaaatataaaaagtcacaaaaaacggttctttataaccataattatagtatatttgcacaggaaatacaatcattaattcgcaaacgtggaaagaatctgattcatcagcgtatacatatcagaacgtgtttttcccttgtaaacgatactgacaatatcatcaccttttttattctttgaatacaaaacaagacagtatcccgctgcgtttgtggtaccggtttttccaccgattacggtaatatcttccggttcggttgtctgaccgtttaaataccggtttgtactttcccatgtctgtgtcacggtattaccggatgcattctgataagcagcatcataacttttggtatggataatgtcaataaaatcctgtgtctggattgcttcctgaaagatcaggtacatatcgtaaacggttgtgtaatgatcatcatccggcagaccgtttgcattgacaaaatggctctgtgttgctcccagggcttttgcttcgcgattcatttcctctgcaaatttatcaattgacccggaataatattcggcaaggacatttgccgcatcatttccactgacaagtaacagtccatacagtaaatcccggacagtaagtacatctccggcagcaagtccgcatttggaagaatccgccatatttgcaatggcatccgcactgacggttactttatcatccagatcacagttacggataatgatataggctgtcagaatttttgtggtacttgccggatacagtttttcgaaaaggttctggctgtacagtacttctttggttgtcagatcaaaaacaccagctccttcggcataatctgcatgaacctgatccgtgccaaaattaatatcgtctgtcacacacagatttcttgcaaaaaactggttgctgacggaagaattatctcccgtcagggagtatggattctggatatccgcggtcttaccggttccgcatccgttcataaaaagagctgctatgcaagaaatacatagcagttttatttttaaatgatgagttctatttgtacatttcacgccagtcaaggtctcctctatccaaagatttaatcaaaagctccgctgtggcaagattggttgcaagcgggatattgtgctcatcacaaagccgcacaatgctgttgacatccggctcatgtgactttggtttcagaggatcacgcagaaagattacgagatcaatttcattgtgctcgatctgtgcaccaagctgctgggaacctcccagatgtcctgcgagatatttatgtatctggaggttggcaacctcctcgatcagacgtccggttgttccggttgcaaacaactggttttttgccagaattccacgatatgcaatacagaaattctgcattaatttcttttttgagtcatgtgctacaagtccaatattcattaaacaattccccctaatattttttcggctgtaatccaacatttaatacaaaccccattcccaaatacaaagaaagcaaagaagtcaatccgtaacttacaaatggaagcggaattcctgtattcggcatcagaccggtggcaacaaaaatattaaaaatactctgaaatccaatcagtgcagccatgccgcaacagatcagtcttcctgcgagatcctttgccttccgggcgatcagaatacattctatcacaataaacagcaataaaaggacaattaccatggtacctataaaaccgagttcctcaccggcaacagcgaagatgaaatctgtctgtggctcaatgatataattcgcatttttcatggatgtggccgcggaattgttcagacctttcccccataactggcctgatccaattgccataatcgaattttgctgctgtgctgcgatatccgaccatctggggtcctgtggatataaccatgccataattcgaccgaaacggtaatctcccgaggattgtgccatacgaagtataacggtaattcctatcaatcctgtcggaatacagattcccaaaacggttaatactattttataacttaatccggcaataaacaagaggctaataaaaattaatgcaattgcgatggaagttgaagtatccggctgctttacaatcaaaagcagaggaattccgatcaggacaaaagaaagacctatggtttttaccgtgttcaggttctctgcatatttggaaaaaaagcgtgcgaaaaataaaatcagcacgatttttgccagctcggaaggctgaaaacgaaaacctccaaaatcaatccagcgctgtgctccaccggcactgtcaccaatacctgtcataaccagaccaagcaggacaatgattccgatataatacaaccaggtaaatctcagaataaaggaataatccatcaaggatacaatgaccatcgccaccataccgatgatacatcctaagatctgcattttctgtacagaatgtttggcacttccaatgatcaggataccgatgatatttaaaaccagtatgctgatcaccaattgaaaatgataatttctaagtttgtattgttttaacatcttaagctcttttcctgttttgtttcaaaacaactcttatctcatagtcatccggagaaaattcaaaataccgtgaaataatatctgaaatttcctttttcattcgccttgctgcagcaggtgaatgttcaaacggtgcggattctgccattaatttcagacgttcacgggcaattggtccggaaccgtcctgtctgtgggaaaaacgattaaccttcatactcacattcctttccgcccagatatatttttccctgccggatgcagggatcttctttattcagatccaccggaatcacacgtggatttgcgaatgctcttgcggcggtcataaatgcacgggtggcctttgtgtgcatggaaagtacaggtattcccttattctggcttacgacaattctttcatcggcaggaattacaccgattgccgaaagtcctaaaatatcttctacatctttttgcgaaagcatatcgtgttttcgcaccatacgggcattgtaggcattgatcagcagatcaatctgtgaaagccgcataccgtccagcagacagatgactcttcctgcatcccgcacagcagaaatatgcggagatgtaacaactactgcacgatctgctgcagatacggcaaagtgaaacccgtcttcgattcctgccggacagtcaatcagacagaaatcaaattcctgttttaaatgggaaatcagcgtatacagcttactctcataatccataatctttctgcagcggagagctgcgggaatcataaacagattcggataacgcttgtcccggatcaatgcctgttttaaccggcatttgttttcgagaaggtcgatcagattatactggatctgatcttccattcccattacaacatccaaatttcgaagtcccatgtctgtatcaagcatgatgacttttttatctaaccgtgaaagtcctgcgccaatgttggcaattgttgtagtcttgccaacaccgccttttcctgaagtgaaaacaattgcttcacccatgaaataaacctcctgttagtttaaattgtaatctatgtgactaatcggcaacagagtttcttatgttaccgttggcaccggctgctttcatttccttgatatctttcatcgatgtttctttatagtaatatgaaattacatttcttgccgcagttgccgcattatgcgaattgtaaccgttggcaattcgtactgcgatggtaatttccggatcatcatatggcgcataaccaacaaacagaccatgattggcatgtccgtcctgctgtgccgtaccggtttttccggcaaccggaatatcaaatccctggaagcggtccatggtagaaaccacttcgcgcatgccggaatgaatggcatcccactggctgcttgttaaggtgtccgaaatatcttcatagtcggccttatattttttgaccgtctttccatctgcatccacgattttattcatcagctgataattatattttttgccggaggccacggctgttacatagcgggacaatgcaacggtggtatagttgttatcactctgtccaatggcagccataaccggatattttgtcgcaacagatgatttgctttccgaaatctccagtcctgttttttgatccaggccatagatatgtgcatatttctgaatcagatcaataccgttggcatcattataagatcctgtttttttctgtgccagccggttgccgaccgtatagaaaaagacgttacaggaatcccgaattgcctcgaaaacattgtcaagtccgtgactgcccggataaatccagcattttggtttgttactgatgtcattataaattccggtacaccggatctggtcggatgtcgtaatcacgttttctgccagaccggctgttgcggaaaccagcttaaaggtggaaccgggtgcggtcttctgctgcgtcgcataattgagcagcggagaagatttatcatgctgcagagatgcaaaatattccgaatccacaccattggcaagtttgttgctgtcatatccgggataacttaccatggcacgaatttcccctgttttttcatccgtcaccacacaggaaccgatacatggttcaagtgcaagctgtgcaggcgtaatctcaatgttgtaaatctttttcatgagaaaatcccgtggagacaacgatccgtttttcaatttgtttacggttgcatcatcataatccaatactccctgatcgaacagaatcagacagagctgacgcggggagatttcgccacgtgtaatcatatactggtatataattttggaaaattccgtatctgtcttaatgttctttagaatatacttgcataatgcatcatatacttctgttgagtccgcatatttttcatcgacatttagctgactgatatcaatccagtgctgtgtgatacagtaatttaaatactctttcgggctgattttctggtctttccatttctggtaaacagaatcactggtatcaatctcattttttaagagtacctgatcgtcttttaacatggaaatgatgtaagtaaattcatccaacacttcatccgacattgtattcagtgcttccggtgaactggtcagttcctgttttattttgccaagcgttgtcttctgccgggatttaaaaacacttaacacacttttttccgtgtcagaggctttcgattttgaaaaatgctctgtgttgatgacactgttgccaatcagagccgtatacacatcgttgatcggaatctcccctgatttgatattggaatacacaatcgccgcaatctcattctgcaatgccagataggtagctttctgcagatctgcgtcgatactcagatacaggtcatctccggctacggaatcggtgctgctgataatttcggaaattcttcctacattatcaatataaaatttctgctctccgtttttcccacgcagataggtctcgtaatactgctccagcccggcttttccgacggtgtcattctgggtataatctttattctttttgtgcagtgccgtatactccgactctgaaatcggtccggtgtatccgatgattgatgaaaaatattcactgtagttatatttccggatcatatcttcgttgacggaaatgccgcttagtgtgtccatgtgctcatttacataagcaacggtcttgtccgatacatcggttgcgatttttacttccttgtatcttgcaaagcggtttccaagcatggcataacgaacaacaacgatacggtatgccagatccccatcatatttcgaactgatgccaaagttgtcttttcccatcagatattccataatctgttctgcggttgcatttgcctcatcgattccggtctccttgtcatattcaagatcatcggcagagccttttccgaaaacatccgcacgaaaacggttcagcgaggaaccggatacattaaagctgtatgtaccgtcttttttccggtcaattttgaaatcattattcagcgtttcaccattattctttaaaaccgtaagaatctctgcaagttctgcattgacagccttgtttttttcttttgtgcttgaataggttgtactgtcattgatggaaatggaatatgcaagttcattgtaagccagaagctttccgtttttgtcatatatatttccacgtgccgcattgatcggctgcttcatctgaatctttaaagaaaagttttcctgataagactttccgttgacgacctgaagggtaaagattcttgcaaggataattccgaaaaatacgataaataccgcggcaagcacaaaaaggcgcgaactgaaaaatttcttcagaaaatctttgatatcataactcaaattttatagctctccttttctcgtgttcctcaagtttctgattaatcttgagaagaataaaatacaaaaagatggttatcaccatggtataaacaaattccggcagtatgacggatgtaaaataataccagaaagaaaaccggctgcgcataaaaaacataacgatatagatcatcaggttatttacgatatcactcgagccgatcagaatcatcggaagcttaatatcatccgggtaaaatctttttttgaacaatccgttgatgtaaccgatgtacatataaagtaaagcatatcctccgagataaaacccaaaaaatatgtcgataagcaatccacaaaagaatccaacccacagcccttcttttttcccacgcatgagtccaaaagaagacaccacaataatcagcagattcggaccgatattggcaaatgtcaaagctcgaaaaacggttgtctgtaagagaaaacagattgctataataataaaaagcacaatttttctacgcatttcctactcctgtgatttttgtgtttcggtattgtcctgtgtttctgtctgagtatcggatgccttctgggaagacagttccttttctccggtgtctttgagtgtcgtaatgacaagcacctcccgcagatgctggaaatcaacgaccggcgtaatggttcccgattttgtcaggttatttgcatttttttcaatggaggcaatgtatccaatcagaattccttcctgatactgatccgacacataagaagtcacgaccggatcgccgacctttaccttatcatcttcatcccggagttctgtaaatggtaacactttatcctgattcatggactttaagctgccaccgacattgaaattatcttttgtggtcagaaccatggaacttacattactggaatcatcgatgatgcttcgcaccttggcaaaattcggaccgacgtctgtgacgattccgaccagaccgcttccggcaatgacgttcatgccttttttgatgccttctttggaacctttgtcaatcgtaaaacttgaaaaccagttggttccgtccatggcgatcacatttgctgcgaccttctgatatccggaatatttatcatccagatccagaagttcccggtaattgtccagttcgtattgttcgagctttgtgacgtttaactgattggtcagatcgtctacctgattttgaagctttttgttttcttttaaaacttctccaagtgtttgaaagtcatttgcttttcctgaaatccaggaaccggcattgttgattcccttctgcatcggaacaaatacatatccggcaactgaatttaaaggacctccggaaagattaaataccagactcgtaaacagagcaacaatacacacgccggtaaggatcagcaaaatatatttacttgaaagatgctttttcttattgcgaaaactgcgaaattttttcataaaatcctcgaatccttgtttcttactttaacgtagtatttttcatgctgaatggaatccgtttatatttggagtccgtagcaatctttgaaagaccgcggactgcgctctcttctggattctcacaggtatttactttaatatttgtaatctgtgtaaacaactggtcaagatctttgatttttgatccgccgcctgtgatataaatacctgcatagataatatccctggcaagttccggtggtgttttctccagaatcagtttgatagacgaacagatcgattcaagatttgctttgattgcttcatagacaacctctgcggtaatttcacgttccaccggaagaccgcttacgacatccagaccaacaacggtcatcgtttcctgtcttcccggaagtccgcttccaagctcttcttttaatgctttggcggttttctttccgatcacaaggttaaattccctgcggatatagctgatgatagactcatcgagacgattggacccgaaatgcatcagatcactgagtacaagtcctccgagagaaatcacagaaatttcgatcgtgtctgctcccatatccacgaccatgactccggtaggctgatttacatcaatcccaagtccaacggcatctgcaagtggtttttcacagagcataacgtttttcggacgaaatttgcttttataaaaaagttcaaagaatgcacgtttttctacatcggtaatgtctgtcggtactgcgacaagaaattctgcattctttactcttccttttaattttttctcaatataatcaaaaatcatggtctgcagaaaattgtaatctgcgatcactcccgtagaaaccggaaacgtaacgttgatgctttccggtgctttttcatacattgcataggcatcatcaccatacgcataaatctgcgttttgttgataatggcaatggtgtttttttcagataccacttttccactggatttactgaatactttaaaattacatgtaccgaagtcaataccataaatattgttactcattgtcttctcccttttcttgtgttataacaatttattttcgcgaaaactgaaatactgctgatctccgattacgatatgatcagcaagggttaatcccaacaccgaggcgcctgcccgaatctgttcggtaagctttttgtcttctgtgcttggagttgggtctccactcggatgattgtgcaggataacgatcataacagcatttcgaagcagtgctttgcgaaacagttccatgggagaaacatatgcataactgatgctcccggttgcgatcacactgtctcctaaaaatttgcatttggaatcaaagaaagctgccataaaggcctcttccctgcggtgccgaagttcttccatataataatcggcgatggaagacggacagttcatggataaatgatatccgcgtccggttctggcaatgcgcttggaaagctccgcaattgctttcagctgtgttgccttgaccgggccaatgcccctgcgttctaaaagctgttcatatccgatttcatacagattcaaaagatttccctgacactccgacaaaagatcacgcgcaagatccaaagccgtataatcctttgttcctgtctttaatataattgcaagaagctctgcatccgacagcgcctctgctccaagaatctgaaaacgttcgtaaggacgttccgattccggcaggtttttcattgaaatgtgactcaaaacaggttcctttctacttttccgaagccacatgaaaactcatattattttagcacagttcatctatattaacaaggttacgttcataaagtttctgtaaagacataagaattccaagcttcgcatggtaccatgtcagacccccctgaaaataaacggcatatggcggtttcaccgggccatctgcggaaagttcgatggaagaaccctgtacgaatgcacctgctgccataataacgtcacagtcataaccaggcattgcccatggctccggagtgacatagctgtctaccggtgcagcagcctgaattccttcacagaaagcaatcatggcatcccggttttgaaattccacagcctgaataatgtcatggcggctttctgtactgtccggaaccactttataccccagtttttcataaatatctgccgcgaaaatggctccctttaaggcaccgcttacaacggtcggtgcaagaaagaggccctgataaaaggactggatcacaccaagcgaagctcctacttcttttccgagtccaggggaagtcaggcgatatgccgcattttccacacattcttttttaccgacaatgtatccgccaatcggagcaaggccgcctcccgggtttttaatcagagaaccgaccatcatatccgctcccactgcaagtggctcccgatcttccacaaactctccgtaacaattgtcaaccatacagatgacatccggtttgatatttttgataaatgtgatcagttccccaatccgctcgaccgacagcgttggacgtgtctggtatcccttagagcgctggatggttaccaggcgggtgttttcatggattgcattccggattccatcgtaatcaaatgaaccgtccggcagcagatccacctgggaataagtgattccgtattcggcaagggaacctttggatgggcggatgccaattacttcttccagagtgtcgtacggttttccgaccggagaaagaagctcatcgcccggacgcagattggacatcagagcgagcgcaagtgcatgggttccacaggtgatctgtggacggaccagcgcatcttccccgccaaaacagtctgcatatacccgctctaaagtatctcttcccatatcattatatccgtatccgctcgaaatattaaaacattctgcactcacacggtttttctgcatggctgcaatgactttcatctgattgtattccgcatttgcatcaatcttttcaaaacgctcttttaattcctgttcgattttttcgccaaatgcataaactttctcggaaattccaagttctttatatttttcttccagtaactgattcattgtatgattcctttctcgtgtaaaacatccgtcattttctgtaacatctgatcttcccggtcattgaattcggatttgtccagccagatgacatccttttcccggcgaaaccaggtaagctgccgtttcgcaaaatgtctggtttcccgtttgatcacatacaccgcttcctcaagggagcagctgccgtccagataatctaaaatttctttgtatcccagtccctgcatggaaaccatatctttgcggcatcccatatcatacagcgtttttacttctgtaagaagtccctgctccatcattaagtccacgcgctgatcaatgcaccggtataatttttcccgttcgtccgtcagtacaaaatatgcaaaacgatatggagatgttttctgatgttctttttcgttgtgtgcggaaatcggcgtatgattctgatggtaaaattccagtgcacggatgactcgtttgatattattttcatgaatggtttcataagaaaccggatcaatttcttttaatttttcatgcagggcatgcgccccgtattcttttgcaaatgccgtaagttctgtacggtatgccatatcggattcctctttggaaaagtctatgtcgtacaacagtgactggatgtaaaatccggttccgccggcgataatcgggatctgtccggcagcatagatctgctgcagggcctcttttgccatctgctgaaaacggacaatattaaactcttcggatggctctaacacatcgatcagataatggggtatccctttcatctcttccggcatgacttttgcagaaccgatatccatgtgtttatatacctgcatcgaatccgcggaaataacggcgccgtttatttttttcgcaagttttattgataaagcggttttcccgacggctgtgggacctgcaagaatgacaagtggtttcatgaaacaatcctcttaaattttttctctatttcgtattttgacatggaaatgatggtcggccttccatgcggacagcaaaacggattttccagcgtcagtaattccgtcatgagtgcatccacttccggcaggctcagtttatgatttccctttaccgctgccttgcaggacatggtggctactttttccagaatcagttccggcgtctgccgtccggtcagatttgaaaaatcatcaagcatttcaataaacagatctttcatgtcaatatggtacagattatccggtactgcggagatcatatattctctgcctccgaaattttcgatctcatacccgaattttttgatttccggcaggtacgtctctaacatttcctgctcatgggcatccagactcaacacaatgggcgggctgactgcctgggatgtaaattctttttcttttaattttgccatcatccgttcaaaaagtaccttttcatgtgccgcatgctggtccataatatacaatttatcctcgtattcgatcagccagtaggtttgaaacaattgtccgatgatgcggtgctttttgcgggcatcatccgttaaaaattccggtgaagcagcggcaagggtcatctgttcgccaaccggttgttttctgcaaagatctgcaggagggacggattcctcccgctttgggaatgggtcaaaagattcccgtaccatggttttatccggccgatgtggcacatacggctcaaatgccggtgctttttttgatggcacaggcgaagccacaggagaaaccggtttttccggaatcggaggctggtgatgttgctgtcggatttcattgattctgcgcttttcaaatggttccggaatcggttctttgtatgccgggggaagattcttttttttatgttctgcttcatctaccgggacttccggaatcagttccttatgggaaagcagtccgaagagaacatcacacaattctttgtaaatttcctgattgtgtccaaaccgcagttccatttttgtcggatgcacattcacatctagggtatcccccggaaatgtgaaatacaaaactgtaaacggatactggtgctgcatcaggaaattatgataagcctcttctatcgatctggaaagcagagaacttttgatgtagcgtccattgataaaatagttttcgtaattccggtttccgcggttaatcacaggttttccaatatagccggaaagggagaaatattctcccttgtagtttacctctaacagagccgccgcaatctcacgtccgtaaatatggtaaatgagatcccgttttttcccatttccggaagtgtgcagccttgtctggttgttgttgatatatttaaaagaaatatccggatgggacagggcaagtttttccagcatgtcactgatgtaggtgccctctgtctgtgccgtttttaaaaatttgcgtctggcaggggtattgtaaaacagatcccggaccagaaatgttgtaccatcgggagcaccgatttcttcgtctgcaatttcttttgagccttcgatcacgtaccgggtgccggtcagggcatcggctggtttggtgatcatttccactctggaaacagcagcaatgctggagagtgcttccccacggaatcctaaagaatgtacacacatcagatcttctgcactgcggattttgctggttgaatgccgcaaaaaggccagtggaacttcttcttttggaattccgcatccattgtccgtgatgcggatcagggaaatgcccccttctttgatctccacggtaatggcggatgcccctgcatcaatggcgttttctacaagctcctttaccacagagctcgggcgttccacgacctctcctgctgcaatcttatcaattgtctcctgacttaataacgcaattttgctcattcgtttttccttttttatatcctaccagcggtttttcactttgttctgaagttcatacagtttattgagtgcatccatcggggtcatgtggctgatgtccacgtcccgcagctcctgaatgatatcgtcatcttttacggtgtcaaacaatgacatctgtgtcagatccacctcatcgagatgcggttttttctttttgccggaggcctgtccttccacggatatatttttcaccgtttccgtaatatcgtttgcagaaagctggttgacaatgtcttttgcacggttaatcacaagttccggaatccctgccagtttagcaacctgtattccataacttttgtctgcgccgccctttacaatcttgcgcaaaaagacgatgtcgtcacctttttccttgaccgcaatacagtaattattgacactgtttaattttccttccagttccgtcagttcatgataatgtgtggcaaacagtgtttttgctcccagtaatttgggattgctgatatattcgacaaccgcccaggcaatgctgagtccgtcgaaagtactggttccgcgtccgatttcatccagaatcagaagggaattcgccgtggcattgcggagaatatttgccacttcattcatttctaccataaaggtactctgcccacttgccagatcatctgaagccccgacacgcgtgaaaatccggtccacaattccaatgttggcagattctgccggaacaaagcttccaatctgtgccatcagaacgatcagtgcgctctggcgcatataggtagattttcctgccatattcggaccggtaatgatggaaatccggttattgtgattgtccagatacgtgtcattgtctataaacatatcattgacaatcattttttcgacaaccggatgacggccgcctttgatatcaatcacgccggattcgttgatctttggtttgcagtaattattctgtcctgccacaagtgccagggaaacaaacacatcaatctgcgccactgcccgtgcggttgcctgaatacgtgcaacattatccgcgatggtatcccggatctggcggaacagatcgtattctaattcgaccagacgatcctgggaaccgagaatcgtatcttcgagttcttttaattccggcgtaatatagcgctcggcattggtcagtgtctgctttctcacatagtaatccggcacctgatccttaaaggaattggtcacttccagataatatccaaacactttgttgtatttgatacgcaggttcttaattccagtcttttcgcgttctttgccctctaagtctgccagccatttctttccatccgttgatgcgttccgcagccggtccacttcctcattgtatccggtttttatgatgttgccgtcacgtacggaaatcggaggatcatcgttgatggaagacttcaaaagtgcacacagatcttccagacagtcaaaatgttcccggattccggtggcaagctctccctttaaatcctcaagcagtgttttaatcggaggcagcatttctaaagaattgcaaaaagcaatcatatcccgcggattggcggtctggtatgtaattctggtaatcagacgttccagatcatatattggtcctaaatattcccgcaattcttcccgggtgatctcctgatcatttaaatttgtaatcagttcctgccgttttaatatctctgttttgtcgatcagcggctgttccacgtaagagcgcagaagtctggcacccattgccgtctttgtcttatccagtacccagagcagggaaccacgcttttgtttttcccgcatggtctctaccagttcgagatttctccgggaagaactgtcaatgatcatatatttcccgatggaatacggacggagttccagaatattagaaagggtgttcttttgtgtttcatacagatatttcagtaatgccgcggaggcaatcacaccacagtcgtaatccatcagtcccagcccttccagactctgtacatgaaaatgggacaacagcgtttcctttgccagatcatccccgaaataccaggaatccagagcggataccgcaattcccatgcgctccttcatatcatcgatatctaccccgctcatataaaacggctcgttgcagatgatttctgtcggactgaaacgattcagctcgtccagcagttttcgttcactgtccacttccgttacaaagaaatctccggttgtaacgtcggtcgtcgcaatgccgtatttatccccgatatatacgatacacatgagataattgttttttgcctcgtctaacgactgcatatcaatgtttgttcccggagtgactacacggatgacttcccgtttgacaattccttttgccagtttcggatcttccacctgttcacagattgctactttgtatccttttttgaccagccggttgatatatccgtctgcggcatgaaacggaaccccgcacatcggtgcccgttcttccagtccacagctttttcctgtcagcgtcagttcgagttcctttgaaactgttttggcatcctcgaaaaacatttcataaaaatcacccagacggtaaaacaggatacagtctttgtattcttcttttgtctgcagataatgctgcatcattggtgttacttcttgtttcacttttttctctctttctaataaaccggatgataacgtttcatcacatcatcagccagacgcagaccgtccatcgctgccgacataatgcctcccgcatatcctgcgccttctccacccggataaattccgtgcacacggctctctccatttgtatcccgcatgatccgcaccggagatgaggtgcgtgtttccatgccggaaagaatcgcatcagaccggtcaaactgcggaataatgttcgaaaaatgttccattccaagcaaaaaggaatgttccatgtcctctgtcatcagacctctgagatttgcaaagcaggtctgcccttttgtctgtgaattaaaatctccatatccttggcttgcgatattctgccggtaatcgccaaacagctgctgcggaatctttccgtttcccagctgataagttttatgttcgagtgtttcctgaaagtgcatgccatcaagtggatcctgtgctccgtaatcggcaggggaaaccgaaacaataatggcagaatttgcgtttttcccacttctgcccgaataactcataccattgacacaggttttttccttcatggaggaagcatttacgacataaccgcccggacacatgcaaaaggaatataccccgcgtccgtttggaaaattggacgtcaccttatagggtgcggcaggaagccgcagggcgtttctttttccgtttccgtacatggcatcatcgatcatctgctggggatgttccacgcggaatcccacggcaaaatttttggcttccatcggaagctggtgccggtgcagcatcataaaggtatcccttgcactgtgtccaagtgcaagaatggcaacatcggcaggaatcaccgtatcatcctccgtcacaagtgcatgcagtgcattttcttttatctgaatgtcttttaaacaggtctgaaaacgaaactccgcgccgtgtttgatcaggtaatccctcatatttttgatcaccttcgccagaatatcggttccgatatgtggttttgcatcataaagaatgtccgatggtgccccaaattttacgaatgtttccagtacataacggtttcttccggacggatccttcaccaccgtgtttaattttccatcggaaaaggttcctgccccaccttctccaaactgtacattggaatccggctgcagaataccggttttccagaagcgttcaacgtccgcactgcggtcttctacctgttttccgcgctctaaaataagcggcgcatatcctgcaagcgtcagctgccaggctgcaaaaagaccacagggaccggctcccacaatcaccggacgccggtttaaacgctcatgccccatttccgaaaaacggtaaccggtttctgtcacaaagctgacggaaggctgatgcagtttttttacgatgctgttttcctgacggatcgttacatagatgcaatatacataaaacaatgacggctttttccgtgcatcgagggaacgccgcatcacctcgtaatgaaatgtttctttcgatggaatacgaagtgtttttctgattttatcttccagatctttttgggaatgtcctactggaagctttaactgattgattttaatcattatgaacctactttacttcctgcgacatgtccgctggaccatgcccattgcaaattatatcccccacagattccatcgacatccaaaagttcaccaacgaaatagatgcccgggacaatccgtgattccagcgtatctgtgtggatttcttccgtgtggattccccctgtgcacacctgagcaacagaaaaatcccttaccttttttaagcggacaggaaatgtctgtatctgtctgcagagcgtttcggtctgcttttgggaaatccgttccgtgtgttcatgaaccggaatgcctgctgccttaagtataaccggaatcagtttatggtttaaaagcccacgaagtgattctgcggcatcctgtatcccggcatcccgtgaaaatctgcgctgcagttcctgcgcaagcatatcttcggaaaaatccggcagaaaattgatggtaagctctgcctgttttttttgatacagtgctttcgaggccggactgctgacctgaaataccggaataccggaaatcccgtaatctgcaagctgcagttctccccgttcctgtttgcagttctgtccatctatgtacaaagacaggagtgcgtccgtgcggactccggatactttggaaaattccattccttctgcctcaaatccacacagtgccggcaaaatcggctcaaaccggtgcccaaacgattttatcagcgaaatcatggatccatcgcttccggatttcggtgcagcacgaagacctgttgcaaaaacaagattgtgggaacaatacgttcccatggatgtccgtacctcaaatccgtattttgtctcacaaagctgccggatgtcacaggaagtgaccagggaaactccgcttcgtttcatttccgcggacagcgcatccgcaacggaagaagcctgtccggagtttgggtatacatatccgttcttttcttttggccagatgccgatctcccggaaaaacgcaagggtatcttccactgtaaactgctttaaaatttcctgtaccagtccgtggtctccgtaataacaccggggagacatcttaagatttgtaaaattacattttccgtttccggttgccagaatttttttccccggcttatccatatgttctaagacggtaacggacaatccacgtcttgcggccgtaattgcggtcatcatgccggaagctccggcgccaatcacgagcacatcctgttgttttgattttttcttatccatagtccacctgtcattttatctgttaaaccagttaaatattttatcatatgggtataaaatattcaactcgaatagctttccaaaaagtcaaaaaggctctcttcatctgcaaatccaatgccattttccgcctgtttctgcagtttttgacttaaattctcacttcgaatcccggtttccatatatacggtttttccatccggtaaaaaaacaaccagccggctgtcctgtgtacggataatataggcattttccgtttctttgtaaggagttccggtcaaaacggtgtgctctgtttcggatgcatattgttcttgggtattttttgtattttctacacctcttttctgataccagatgccaaagaccagcagcagaaccagacaaagaagaatgcagatgcctgttttttgattcatatcatcaccttctaacagtagcatctgcattttatttccgttttataccatttactttaataaatgtattttttttgcaacccggacaatcagagttcctttcgggaattttttaatctcctcttcggtcagtccgtgcagtaacagtaagacaactgcatatacgataaccgctgcaagaattgcaagcatggcagataccgcattgatttttaaaaccgcatagctgccatgatagacgatataggtaataattcccataataaccgaggaaattcccggcacaataaatgttttgtgaatttcctgatgatagccgctgtattttcgtattgccagcgcattcataatacacattaaaaacgcaaagaacatatttgcgataatgaccgcatagatattcatgcggaaaaacagcatcagtataatcagtacgatcacatgagcgacaagcgaaaccgctgcattgataaccggaatctttaaccggtcaatgccctgcagcagtccgtttgaaagcgtagacattgcataaaacacaaccgccattgccccaacccacatcatggtacctgccataggtgccgtctgtgccgttcccgggaaaagcagacgacagatcggctctcccaatacagcaagtcctatggcacaagggaaagaaatcaccatgataaaacgcatggcagaattgatctgttccctgacttttttcatatctttctgtgcaaaggacatcgtcagtgtcggcacgcaagaggcagccatcgcggaggcaatggaaatcggaacattgatcagcagtttatattttccggaaaaaacgccccaccatacatcaatcttgttttcagagtatccctgcaataacgcaacatttttgaaaatactctggtcaatgatactgctgatattgtaaacagttgtacttaaaagaaccggaacaattgtgataatgaggatcttcatggtataggcaaatggctctaccttaacgcctttttcccgtctcattcttcgcttaaagacatgcatataagcaaaaaatacgaaaagtacaaaaatcagcgcagcgacagatccaaggttcgttcccaatgtgcctccggctgcaccgtatgcaggcccgtaatgttcggtatcaccgagaaccgctccgatctttgttccgtagcgatacagaacataagctgcccatacactgatgatggcattgacaatctgttcaatgatctgtgaaatggcacttggcatcatcgtgccaagtccctggaaaaatccacgcaaaacgccaagaaccgcaacaacaaccagtgccggtcctaaaattttaagtgcaaacacactgtatggtgtttttaagagtgttccggtaaaaaattcggctccgaaaaatacgacaagcgatgccacaaatcccgataccagcgcaaaaagaagtgcaccttttaatacctgatataccgaccggtaccgccctttggctgcttttgcggaaaccgtctttgacactgcctgtggcagactgtaggatgaaataatcaaaattacgttgtacacgtcaaatgcacatgcataataactgattcctacgtctcccagaatattgttcaatggaatacggtacaccagtccgatgattctgcttataattgaagcggccgcaagaattgatccctgaaccagaaaatttgttccgttattctttgatttacccatcttctaacctcaatgcttttgtttcttttattccgcgctgattttattttgggatgcacggctgttttcgacgatctctacccatgtctttccgggatttaaaataatttcctgaccatcctgtgtataataacgtgtaatatcatttgcggatgctcttttccatgtaatcgggacagcttttccgtttgtgatgtacattcctgatccaccggaaagataatcgatatctaaagttccgtttttggaatctttcaggctgctgtaacaattctgtaaaatgatatttttcacagcaagctgttctccggtagaaccgtcaatctgtttatcaccaaattcatagcggtaatacagaccatccgtttcattgtatacaaaccagggcttcgcgtcaacatagtataaggatacttttttcgcaacttctccctgatccagcagattttgggaatcttccgttgtaaagcgataatgcgatgtataattttccggaagctttgtatcatacccgtatgattttatggcagacactaaattttctccggttgtatacagattatgcggtgccctgcggcttttgtcgcggtaataaaaagccccgccttttcctgtaattccatccacatgatcaatgaacgaactatttaaaacatcaagtgcatatttactttcgcctgcatgaaaataaaccgcctgaaattctttggcaaaatacacataatacagacgacagcttcgcacatttcccacttttttaagagaagcataatcctgataaattgtcatcagccgggtaatgccgccttccaccggacattcatagataatatccgcatttccgattccatactgtggaagggttacgtgtgtgttttctgtcatgacggcaaccggacgattctttgcttttttttcatccatccactctcccgtatagaaacttcggacttctccttcgtgggtttccaccggttccggctgatattctgtttcggcagtttctgcaggtacatcctgtgtggatgaaggtgtgggagcttccgattctttacttttgcatccggcggataaaatggcaatcgcacagacaacgcctatcattttccatctctttttcataaaacacatccattctttaatctcttacgatatgcatctcttcgagtatctgtttttgtttgggttccatgatggccgcatctttcggatcaatgtggtcataaccaaacagatgaagcatgctgtgcacaatcagaaatgcaaattcacgcttcggactgtgtccgtaactttgtgcctgttctaacactttatcgaccgatataataatatctccaagcatgacttctcccgtatccggattaaaatcatcttcactctcctcttccagaaaagaaaaatctccggctttctcataagaaagcatcgggaaagaaagaacatccgtcggacggtcgatctggcggtattccagattgatccgatggatttcttcattgtctgtaagtgtcagattgacttctgcttcataaggaaaattctcatgggacagacaaaaggcaatcacatcctctgcaagcttagcatatgcaaaatcaaacggtatgttacatgtttcttctaaataaaaactcaacgaagtaattcctcctttgcaagaaattcacgaatctttaaaaactggttcatactcattccggaatggtcataaatttcacttgaggaaaaatcattcacggtctgataaattacaatatcacggttccagacactttgtcccacattttgttccatcgcttccagacggatcacaaccgcatccaccatatgcaccagagcggattccggtgaagatggaagctgctcttctccatagtattctgccagaatggagatcagctccgccggaaaacataaggattctgccttattgaccgcatttttgatatatggctccccgatccagcgccccatacggtaataaaaaccgccggcaagacataagttcgcccggtatcccacttcttttgcacagcggcaggcaatgtctgaaactttcactgcgtggcggtattccaccatggaaaaatccttgagggcttttacctccgaataatcctcggacacgatatccagcagatggttttcaatttcctgatccgcttcatgaagcagccggtgaaacagaaaagctgctgtcagaaaagtcaggaatgctgttccaaaagcataaagcagcgaatatttctgcatttctttcgttgataaataggaaaacagttccggaatcatcagactgaaaaagaaagtcagaagggatacacccatacggtattttttttcttttaatgcctgtgccagtacagcagcaagcattgtaagcatcatataagcagcaagggcataaaaacttcccccgacagtcagtgccagcaccagatcgaaaaacaatccaaaagacaccgccaccatggaatttgacactgcggtgagcagaatcaccgggatcatcaccggacggtaaaattccggaagataactgatcgcatagatcaatcccccactgaccgtataggtaacggaaagacggataaaggttgtctgtgtgtttgccgatattcctttctgctttcgttcatattccagttcaaaaatgcagaccagaagaaaaatcagggtcaggaaaaacatactgagccattcatccggatacaggtggcttttggcacataacccgcccatcactccaaaagtgacaagcgcgatcaccagaagcgatatgacgcgatagaggtttattgtctctttgggtttcattttttctcctgtctggcagacttacgcgcactccggctgctctgtctggactcataatcatcataagcctgtacaatcttttgtaccagcggatgtctgacgacatctttgcttgttaatttacagattccgatttcttccacatttttcaaaacccgaagtgctacatccagcccggatttacttcccggggccagatctttttgcgtggcatctccggtaatcacagctttcgagccgaagccgatacgtgtcagaaacattttcatctgtgccggtgtggtgttctgtgcctcatccagaataataaatgcgttgtcgagtgtccgtccacgcatataagccagcggtgcaacctcaatcagacctttttccatatttttctgaaatgactccgcacccataatctgatacagggcatcgtataaagggcgcagatacggatctactttgctctgcagatctcccggaagaaatccgagtttttctcccgcttcaattgccggacgtgtcagaatgatgcgtcccacttcttcattcttaaacgcagtgatcgccatggccatggccagatatgtttttccggttccggcagggcccatcccgaaaacaatcatttttttacggatattatctacataatccttctgcccgagtgttttaggctttaccggttttccctgtatggtatgacagatcacatctttatccatctctaccatctcagaccctttgtgttcctgcaaaagagcaagtgcgtagtttacattctgttcgctgataacatttccccgttttgcaagctcatacaactgttcaaacacttcctgtgcgccgcttgcggcagatggagtaccgataattttcaactgatcatcgcgtacaacaaccgttacacccagtgtccgttctatttttttgatattggcatcaaactgtccgaagacatttgccatatgttccgttggtatccggagcgatacttcattcagactcatttacaggttcctctcgtttcctttcggttggtactaaagttgtgattttttcacacccctttacctgaccatagatatgatagttttgatctatctgttcaatcataacatttttgtcgacaattcgcaccccattttcttccaattccgaaagaaattgtgaaaaatgtgtcaaagcaagctgttttacctgttcttttgtcagcataacggtcttttcctgcagctcagacgttgtgatttctccaaaataaaccggaagataaaaactgtcctgcaggcaaaactgccgggtatccgttacagaacgctccgatgtatactccgcatgcaaagccggagttaccagacgccaattcagaacctgtagaaaatatcgtttgtgtttattaccggtttcttttttttctgtcattttggaagaaatccagtcctcatagggatgcatcgtatatccatatacatcggcatcggcgcttttataatagtattcccgcactttcccgttatcatccagaatttcctgccgtccacagaccagcacatcgccttttttcactttatcaccctttttcactttggcaagcccgctccttgtaatgaccgatgcaatcgtagcatccgcagatgccgccagatccatacaggtgccctctgcttctttcgtttcctcgtgagaagaaattttctcctgtatctgtacaaccagccgggttcccgtttcgtatacacttgcccagatcaccggttccaagtcctgacgcagggacagctccagtgcatcattgtcgatttcctttgccggcatgccataggtaacgttgtgtgcacttaaatattccagaatggcgtcttctcccagagaggaattccctttgatttcaattctccagattctcgtactgagcacccagactcctgccatgacacacaaaaggacaaaaattccaagttttcttgcgcggtatttctgccagaaaaacggaaagccgatcctttttctgatgtggattctcgtttttgttttccgcagatatggacgcagttcatacagatcctgcaaccggatataaaaagaaacctgcgtcggagaatccggctgtatcttccagaacataatttcgtgacgtgcacataaatttaaaaaacgggaaatgttgcttccgcatacacaaaccaaaagactgccattgacgaatcgaagaaacctttctatcatggcagaaatgtgatctcctgcatatatccggaaatttcgataagatccgccgaatatttccggatggacagactccttccgacgatccggatatgataggattgtgttgcaattccgatcacctccggacagtattttataattccacggtggttaacgatacaaagtgtacggttcccctccatggaaagaagcggcattcccaggaaaatgtcttttggcagttccatttgttctacgagatgctcctgttttattttgtgtctggtttgattcgaatggcttttcatacttcactatatgaaaagcgaacccgtcctatgtctctaaattcagggatccgtttcggtacgcttccaaaaatacattaaattctacggtcatcatcataatatacatgcaaaaatacagccagagcatgatcagggcaatggttgtcaggcttccatacatggaaaatccattaaaataatcaacatagatggaaagcccgaaggaaaaaacataccatgcagctgcacatgccgtggctccaggaagctggcttttaaaggtaagccttgtattcggaagtgcggtaaaaatcacgtcaaaaaacaggatcagaagaagtaacaggataagccccccgaatttgattattatttttacgagatgtgcaataaacggaagataatctgccgctaaatgccgcagactgtttccaaaaaccagcacaacaagcgtaaatacaatcgcaaccagaaaaacaatggtataaataaccgcccagaatcggagtacaaaccaatttcttgtctcttttaattcgtgaaccgcattcagaccatctgccatatactgaatgccttttgcggcagaccatatggcaataattgccgtgaccgaaatgattcccatggatcttgtatagatttcttttacaagggtaaccagaaacggagcaacatactgcggcatgactctttctatgatttcaaataccatatcctccgtgatactggtatattgaagcatggaagaaaacaccataagaaacggaatgatggataaaataataaaaaaagcgatctgtgcggaataagcatttattttgtctttctggcatttggctaaaaaccgggtaaccagacgtattgctttttgcataccaaatgatcctttcttctttatttatgatatggttcgtgatgcatgatacggtaagaacgataaatctgttccagcagaatcacacgcatcagctgatgggggaatgtcatcttcgaaaagctgagtcgtgcatctgcccgcttaagaaccttgtcggataatccaagagatcctccgattacaaaataaatatgactgactccgccaagcccgagtttttcaatttcacgggaaagttctatcgaatccggctgttttccatcgatcgccagcgcaatcacatagccgtccgggcggatggattttaaaatacgctccccttccaggtctttgaccatggcaatttcggtttcgcttgcctgttcttttgtcttttcatccgccacctccgtaatggataacgtacagtagcggctgagccgtttggaatattccctgacggcttccgtataaaatttttcctttattttgcctacgcagataattgttattttcatgttgttattttactatatttctctgtaaatttgtagtaaaaaatgatatactgtaatcaacaaatacaagagaggtaacgaaattgaaagaattacaggaaagaattaaaaaagatggaattgctgtcaatgaagatatcttaaaagtagacagttttatcaatcatcaggtagatccggtactgatgcagcacatcggggaagcttttgcggaacacttcaaagatcagggcatcacaaaggttgcaaccattgaaagttccggcattgctccggctcttatgacagctatgtgcatgggtcttcctatgattatcttaaaaaaacagccttctaagattttaaacgacaatctgttccagacagaggtcacttcctttaccaaaggaacaagttatgaactgacgctttcttctaagtttgtctcagaaaaagatcatgtcctgatcattgatgattttctggcaaacggagaagcagctaccggagccatccgtctgatccgcaaagcgcacgctaccattgcaggtgtaggtgtcctgatcgaaaaagcatttcagccgggacatgaaaaactggtttctcagggatttgatgtgtatccccttgcaagaatcagccatatggcaaaagatgagattgaatttctggaagattaaaccacctcttccacaacagggagtgttgatatgtccatgcagttataaagcatcggcaatcacactccctgtttgatttttaacaatttctatattattttattcttctgcattgtctgcaggatcatctatagcatcttctgctgtatagtcctgtgaataataaataaaatttcctctatatacatccgaacttaatttcgtcgtatgatcaatgatcacaaccgaaagaatattgtttccttccggaactttgatcggctgcgtataaagatgactggcagcagtcggcgtacttccgtcccaggtatagtaagcactgcagccgtccggaacggtaatcgttacggaagtttccacgccgaaatctccaccgtccggagaaacaatcggttcatccggtgccgggattaaaattttatagtttgcttctgttacctcactgtaaactcccttttcgtttttacataccgcttttacggtataggttttattattttcatccagtttcacaggttctgtgtatcgcaatccgcgttcttttggatctgacccgtctaccgtataataaatttcatagccttttgtggaaagcatctgtagtatctgggcattttcaaaacttccgctctttaaactgaactgtggtccctctacctgataatcggcgaaaagatctttcagactgtcatccacagcctcggagagagaaagtatggcatcggtattgttctgcttctcataaatggcaatcagtcctttgcatgcctgacggtttttcctgtccgcacggatcacttcctgatataaaacaagtgccgaatcataatcgttttctccggtgtacagatccgccagagccagccggacttcaatactgtttttgtccagtgccagtgcattctcgtagcaggcaattgcatttttggtatctccggctttttgtgctttctctgccagtcccacctggtaatcgaaggaattggcatgattggaacggattgctgctccaagaattaacagggcaaaaataagcacgcatacgattccgagaaccaggaagataatttttttctggcgtgggtcgaggtgttttttccccggatgttttgtctctgcaggtgccggttttttatttctgtccggtctggaacctgaaatcttttgggattcttccgtaagaacctgattcagataatcatcatcgtaaatattgtagtccggtacaatctgtacggctttcccgcattttggacagtacagactcccctcttttaattcctcaccgcaataaatacacttcatcatctatcccctatctgttttatgaataaagtttcatggcatctacacagttatgcatgagcatcgcaattgtcatcggtccaacaccacccggaaccggtgtaatataagaagcgatctgctctgcctcttcgaaacggacatccccgcaaagcttattttcttcatttctgtgaattccgacatcgatgacaaccgctccttctttgatataatcggcaccgatataacgtggttttccaatggccacaatcagaatatccgcctctttgcagatttctttgagattttcggtccgtgaatgacagatcgtaaccgttgcattttcccgaagcatcagaagcgccatcggttttccgacaatgttgcttcttccgattaccacacagtgctttccggcaatttcaatattgctgcgttttaacagctggataataccggcgggcgtgcaggagacaaatccttttttcccaaccacaagtgcaccgacattctgcgggtgaaaaccatcgacatctttttgcggatcaattgcctggatcacatggtcttcgcagatatgtttcgggagtggaagctggcacagaattccatgaacatctggattgtcattcagtttctgaatcaatgcaagcagttcctcttccgtggtttcttccggaagttcatacgaaagcgactctattccaatatatgcacaggctttctttttatttctgacatatacgctggatgccggatctgcgcccacctgaatgaccgcaagtgcacatgttttcccctgtgctgcatatgctgcaacttctgtctttaattcttctttgatttccgctgaaatcttctttccatctatgatctttgccatgccattatctccttagaacaatcctgtgattacaccgtcatcattgacatcaattccgtaagctgccggtttctttggcagacccggaagcgtcatgatcgaaccgttgacagcaacgacaaagccggcaccggcagaaacatatacttcccggacattgatcttaaacccggtcggtcttccgagtttcttcgcatcatccgacagggaatactgtgtctttgccatacataccgggaagtttgccatacccagatccgtaattcgtttcagttcccgctccgctgccggagaataggtaactccatcggcaccgtaaatttcttttgcaaccgtctcgatcttttctttcagtccaagatcatcactgtagagtgtatggaaatggctttctttcttctcaagtgtctcgagaattttgtttgccagagcaattccgcccgctccgcctttttcccatacttttgccagagcaaattcacagtcatgctctttgcagaaatgttctacataagcggtttctgcctctgtatccgaaacaaatgcattcaatgtgacaacgaccggcacaccgaatttctgaaggttttcaatatgtttctccagattgacaattcctttctttaatgcctcaaggttttcattggataattcatccttcaaaactccgccattgtattttaatgcacgaatcgttgcaacgagtaccactgcatccggatgaagccctgccttccggcacttgatatcaaagaatttttccgcacctaaatccgcaccgaatcctgcctcggtaattacataatcggcaagttttaaagcagttgtggtagcacgcacgctgttacatccatgtgcgatattggcaaatggtcctccgtgaacgagcgccggtgtatgctccagtgtctggatcagattcggctttaacgcatcttttaacagagctgccatagatccgactgcttgcagatcttctgcagttaccggcttgccgtcaaacgtatatgccacgataatccgtcccagacgtctctttaaatctttcatatcttcggcaaggcataaaatcgccataatttcggatgctaccgtgattacgaaatgatcctcacgcaccattccgtccattttatttccaagtcccacaaccacattacgaaggacacggtcattcatatccagacagcgtttccataccacctgtcttggatcaatcccaagcgtatttccctgctggatatggttgtccaaaagagctgccagcagattatttgcagaagtaattgcatgaaaatcccctgtaaaatgaagatttaaatcctccatcggaacaacctgggaatatccgccacctgcggccccgcctttaattccgaaacatggtccaagggaaggctcacgcaacgcaatcattgcttttttcccaagttttgcaaatgcctgacccaatcccacggtgactgtcgtttttccttctcctgctggtgttggattgatggcggtcaccagaatcagttttccgtccggattgttgtggcttcgtgcaatcagttcatcggaaatcttcgctttgtactttccgtacaattccagatcttcttcttcaattccaattgttgcggctacctctttgattggctgcaatgttgcttcctgtgcaatttgaatatcagtcttcataattttctcctcctgaaatgttttttataaatcctcttttactgcctgtaattcttcggaagtcatcagaactttccgcggtttcgttccttcctccggtccaacgataccagcttcttccaactggtccataatacgggcagcacggttgaatcccacttttaaatatctctgcagcatacctatggatgctttttccttatctacgataatctgtgctgcttcatcaaaatatgcatccctgccgtcatcctgcgcatccgcatcggagatagacacggtggtaccgccggatgatgcctgcatactgtccactttctgtacaatttcttcgttatacgatgcagtttcattttgttctttgataaattccacaacatcggaaacttctttatcggaaacaaatgctccctgtacacgaatcggtttcggtgccccctgcgggtggaacagcatatctccttttccaagaagcttttctgcgccattcatatccagaatcgttcgggaatccgtacccgaagtcaccgaaaatgcaatccggctcggcatatttgctttgatcagaccggtgatgacattcaccgatggacgctgggttgcaatcaccagatgaatccccgccgctcgtgccagctgtgccagtcggcagatggcctcttccacgtcattggaagctaccatcataagatctgcaagctcgtccacaatgatcacaatctgtggcatcttttgcgggcgctcctgcccttccggtacttcaatggaatctacctttgcgttgtatccattgatttcacgcacatttgcctccgcaaatttttcatatcgttccgtcatttccgcaactgcccagtgcaaagcaccggatgcttttttcggatcggttacaaccggaatcatcaggtgcggaattccgttgtagacacttaactctactactttcggatcaatcatgatcagctttacttcatccggtctcgccttatataaaatactcatgataatcgtattgatgcagacggatttacccgagccggttgcaccggcgatcagcagatgcggcatctttgcaatatcggttacttttgttttcccggaaatatcttttccaactgcaaaactgatcttggactttgccgtctgaaattccggcgattcgatcaggtcacggaaagcaaccataacattttctttgttcggaacttcaattcctaccgctgcttttcccggaatcggcgcctcgatacggatatccgcagctgccagattgagtttgatatcgtcggtcagcccgacaatcttgctcaccttcacacccatttccggctgaatttcatatcttgtcactgccggtccgcagctgatgttggtaacggtgacattgaccccgaagttctttaacgtctgctgcagcttatccgcagtttcccgcaactgatgttcagtattggcagactttttcccttctccctttttcaacagatctatggatggaaaaacatatgctttgtccggtttgtgttccaaacccgacgtctccatttcctgtgctactttctgtacttcgttttggatttcctgttcgtttttctttttttgtgttttttctgccggctttgatgcatcttttgccggttttggaatatgttccggaaccggtgccgcctgcgacggttccggtggaaaagtatccggcataaaatcccccgaaatctccggctgtatttctgccgcgggttcttctaaaaccgccactggtgccggagaagaaattttttccggcatcggagatactgtagtatccggcatcatatcaaatgcaggtgccgacagttctcccatttcatccgattttctctttttattttttttgcctttttcttcaatccgtgtatcgatggatactccggacactttatgatccatgcggcgttctttccgctcctgtgcacggtattccctgtattcccgatacttttcattgctttcctttgcggattcatagacctttttgccgcctttttgcattccacgcaatgccgaacgctctgtaatcagtaccatacagacgatcagcacgataatgtcaataataaaagacccgatcagtccaaatgcctgacacatgtaataagccagacatccgccgatgatgccgccaccggtatgccgttctgcacaatatgtatatgcgtcaagtggatggatccggtcgtttccattcatggccagtcccataaatgtacataaaaagaccaaaaatacaattgccgcaatcaattttacggctgccagcttatttccacggttcgataccgcaaaaaaactgcccacaagaagcagcaccggaagaacatatgccataagtccgaacataccaaaaagaaagccgctgacggttttgccaacggctcctccgaatcccagattactgataaaaagcagcagcgcagctgcaacaacaatccacaacgttacttccacgcgaaatgcctgtgctttctccatttccgccatacgctctttttttgtctgtgtttttcttttatttgatgatttacggtttcccgcagccattggacacactccttcatacaaaactctttttattttatcatatttacaccagaatgtcacccatcagcttttttaattatttttaactattttcccctatcagctgatacagctttgcaaatgcatccgaaattcccccgacagcatcaataatgccttcagacactgcctgtttcccgacaagaatcgtgccgagatccttggtcagcatttgcgtattcatcatcatttctgtcatccgttcctccgaaacgtgacaatgggaagccacgaatccggcaatccgatcctgcatctgtttaaagtaatcatatgtctgttttgccccgatcacggttccactcatccgtaccggatggatcaccatggttccgctcggaacaataaaagagtaatctgtggaaacggccagcggaacaccgatggaatggctcccaccaagcactaaagaaacggtaggtttcgaaagcgacgcgaccatttccgcaatcgcaagtccgctctccacatctccacccatggtattgagcaataacaaaacgccatttacactctcatcgtcctcaatcgctgccagacgtggcaggacatgttcatattttgtcgtttttgaagttgacggaagacattcgtgtccttcgatttctccgataattgataacagataaatggttgtatttctccggtctgcatgtaacattgcctgtccgaattcaataatgttatcattttcttttttggtatctcccattgttttttcacctttgccattcataaaaataagaacggatacatttgtatccgttcttatcttatgaattattttctgttttattcaccgagaagataattatacagtccctcatagcggaattttgacgcattccatgaaaaatcatttgccattccacggtctaccatctggttccactggcgcttgcggtcatagaaaatatgcttggaataattaatcacctgcagcatttcgtcagcgttgtaatttgtaaaggaaaatccatctccactgttatcatattcattgtaagcctgaaccgtgtcttttaatcctccggtttctcttacaatcgggacggttccataccggaaagaaatcatctgtgtcagaccacacggctcaaagcgggaaggcattaagaacgcatccgctgccgcataaagcttgtgtgccaaatcatcagagtaacagatatttgcagaaacccggttcggatatttccatgcgtaatgccggaacatattctcatactgtggttccccggttccgatgactaccagctgggtaaattcatctaccagtccgtccatgacggcattgatcagatccagccccttttgatcggtcagacgggaaatgagtccgatcatgtatttcttcttatctacttccagaccaagttcttcctgcagccgttctttgttcacatacttctttttccggaagttggacgcatcataattcatgtaaatcttggaatcggtctgtggattgtaagtcgtataatcaattccgtttacaattccctgcatgtcaaaatgacgtgcagataacaggccatttaatccctcgccgtaatattcggtctgaatctcctgcgcataggtatcactgacggtagtaatataatctgcataaacaagtccgccctttaacatatttgcatctttattaaattccagcttatccggaacaaacagatcacttgagaatcccgtaagtccctgcatggtttttacatcccagattccctggaacttcagattatgtatggtcataatcgaccggatgccccagaagaaagaatctgcctgaaattcgttctttaaataaacaggaatcagtccggcctgccagtcatgacagtgaatgatatccgggcggaaaccgatcagcggaagcatggacaataccgctttgtcgaagaacgtgaatttttcaatatcatagcgcatatctccatacggtacgaaacagttaaaatactcctgattatcaatgaaataataggtgactccatccagtttatattgtaaaacccctacatatttacttggaatataagaaccgcatgccatataaaaatgggtcacatactcaaactgactgcggtatttttccggaatacagctgtaattcggaataacaacacgcacatcccaatccttatgatcaaatgttttaggcaaagccccacatacatcagcaagtcctcctgttttaataaaaggaacacattctgatgctgcaaataagattttcttcatacctgcctcctaatttaaaaccctgttttgcgtatgacgcatttttacagtatgtaattttactcttcccagttgtgatatacttcctgaacatcatcatcgtcatccaggaaatcaagaattcttccgatatttgtaatatcagcctcatcggtcagcgtcacatatgtctgtggaatcatggttacttccgcagatgccatcggaatgttctgctcttcaagtgccttatgtaccgcatcaaaatcttccggagcggtagtgatctcaaagctgtcatccacatcggaaaaatcttctgcacctgcatcaagtgcaagcatcatcagatcatcaccatccatatcacattcttctttgtcaatgataatctgtcctttttcatcgaacatataggatacacatccctgtgtaccgatacttccctgtcccttggtaaatgcattacgcacattggctgctgtacgattcttattatccgtcaggcactttacaataattgctgtgccgcttggtccatatccctcataagttgttgtctcgtaattaacactgtttccatcgcctgccgcttttttgataccgcgctcgatggtatcattcggcatattgtttgactttgcctttgcgattacctgtgcaagtttgaaattatttgccggatccggaccaccctcttttaccgcaacagcaatttctctaccgatcatggtaaagatctttccctttgctgcatcatttttttcttttttgtgcttgatattcgcaaatttggaatgtcctgacattgttaaaatcctcttttctaaattgtattctatcctgtaaccatccatacttcatgtcattcgtacagaagcattacctgtattttattctatcattctttgccgtttcgcgcaagtgggtcatcctccggccgctgatgctttgcatctgctttttttacaagaacctcacggatcattttatccttcactttccgaatggaaaattcatatccgtacgcctgcaatctggcagtttcaccatcatttggaattttttccatcagggaaaccagaaaaccgtttagcgtgtcaaaatcatcatcatttaccggaatctgtaacgtttccgccacgtccgaaagacttgcgaacccgctcatggtataacttccatctgtattctggcgaatcagctgttcttcctcatcatgctcatcctcgatgtttccgacaatttcttccaggatatcctccatggctaccgcaccggatgtctgtccatattcatctaccactatgaccagatggctcttttttgcctgcattttctggaaaagagtatgaatatttaatgtttccggaacaaaatccacctcccggatcagccccttaatgtctttgatggaagtacggaatacctcatttttctgtgcaaaggcaaatgcgtctttaatatgtaaaacaccgataatattatcgatgtcctccagataaaccggatatcttgacttattgttttcaatgatgaacggaacagcatcattataggaaagttccccatcgatcgcaatcagattctttcgatgtgtcataatatctttggcttctttgtcaccgaattcaaaaatattgtgaatcatctctgcctccgaagcacgaagaactccctgttcgtgtccttcatttaccatggaaataatctcttcttcggtcacatcatcctcatgggaagacgggtttaaaaatcctataattttttttaaaatattcgtcctgccggaactggcactatcgtccatttcgtttctcctttaatgtatataatactccaaatcataccatgggaactgtattccgtcaagttatgtatacaattccaggctgatctccagtgctttgtcaattttcaaaagaatctgatgatccagatgacatactttatctttcagccgctttttgtcaatggtccgcaactgttccagcaaaacgacagaatcctttgccagatcgtatttgtcacagtttaattcgacatgtgtaggaagttttgctttatgcatctgcgaagtaatcgccgcacagatcacggtcgggctgtgccggttcccgatattgttctgaatgataagaaccggccggacgcctccctgttccgatcccacgaccgggcgcagatctgcataataaacatctcctctttgaatcaacatacgttttcaccccatactttgtgatactaaaagtatttccatatttctcacatgtattcaaaaagatgatttcatactatatgttattcaaaaaggagacatctgtgtaatcttatgattcctgtatacagattcttggcacacgcggtgtgatcagacatgcaaattcataattgaaacgaccggataattcgccaagctcttccatcgtgatacattcgctgccgtcttttccgagaagggtcaccggatcaccttcttttgcttccggaatttcggtcacatcgaccataaactggtccatgcagactctgccgcagatcggagctttcttcccgtgaataagaacatagcctttattggaaagccctcttgcataaccatccgcatagccgaccggaatggttgcaattcttttttctgacggtgtctcatagataccgccataactgatcttacgcccttttcccagtgtcttgacaaaagcgatatggctctttaaggacatcaccggatgaagggaaatattgtgtgccacttcctccgatggccacataccataaagagtgattccggctcttaccatatccatatttgcttccgggatctctacaattccggcactgttggagcaatgatggatcggtattttaacattccgttcctctaacattgttatcatcttctgaaaaagtgcaatctgcttttgggttggggttttatcatactcatctgcctgggcaaaatgtgtaaaaattccttcgatctcaatattcggaagttttgcaatccctgcaatcaggtctgcactgtcttcggtaacctgcagaccgatccggctcattccggtatcaattttaatatggatatgacaggttttattttttctgacagcgatatccgaaagagcttttgccgcctcatattcacagattgcaggacgtatttctttttccacaatgagctcataatgttccggaaaactgattccaaggatcagaatcggtttctttcgcccatccgcaatcagcatctccgcttcatccgcagttgccacggcaaatccccatacatacggaaggtcctcgattgtttttgctacggtcagtgccccatgcccgtaagcatctgccttgatgacggcggcaattttggttccttctttaatatttttatgcatggattccatattatagcgcagtgcatctaaatcaatgcctgcataaacacgattttttttcatgatttttctacctctttgagtccttctatgatatcggaagccatcattccccggactccacatttttcttttgcggcatctcccgccagcccgtgcacatacaccccaagaggtgctgcttcctctgctttcattccctgggcaagaagggaaccgatcacacctgccagcacatctccgcttccggccgttgccattccattatttcccgataaatttacatacgtcatgccatccgaaacggcagtaaccgtatgaaaatcttttaatacacaaatcacatggaaacgcttcgcaaaggtttcggcagattgctccagtgtggtcagaatttcagaaaccggttttttggtcagccgggacatttctccgggatgcggtgtcagaataatgtccgcctttgcctgttctaaaagttctggttgatccgcaatgatatttaacgcatcggcgtccaaaaccagtggaacgcggcattgttccagaacggtggatgtcatgcggcgtgcacgctgtccggttccgattcccgggccaaatactacggcatccgcccactgcagctgttctgccagcaaagtttcttcctcgttttcctgcccggtgacaagaacagcttccggaacctttgtctgcagaatcagccggttttgttcacaggtgaatacccgcaccaggccacttcccatacgatatgcagcttttgcacaaaaacatgccgctccggacatattaacacttccggcaataattagcaactttccatacgagcctttattggtatgtgccatacgggagggaagtttttttaaatcttccgattccagaacagccgtatgcggcttatcatccagccagctttcctgtgtaattcccatggaaaccacatgtacatttccgcagtattcattgcccggccacagatactgcccctttttcccgaatgaaaatgtaattgtgtcatctgcccgaaaagccgtgccaagtactgccccatcatcggaactgattccggaagcaatatccacggcaactttccatccagacaattgattgagcacgtcaatatcgtttgcaagtgctccggatatttcccgggacagaccggttccaaacatggcatcaatgaccacatcataggatgcctcccctgcggaaactttctccttttgcacgaccggaatgcggtaggcactgcagatctgtttctgggtgtcataggatggactggtccggtgctcttcttcctctcctgccggccatacggacacaaaaaccccctgttcccgcaaaagtcgggcaatggcaagtccgtctcctccgttatttccgcttccacaggcaattaatgctgtcgataatttattttgtttaagcactaaaagcttctgcacaaaagccatcgatgcctgttccatcaataccagttccggtacatgaaacacctgcgatgtattctgatccagaagcttcatttcttttcccgatacaagataacgcaagatttctaactctcctcttccttttgtgattctttcgtatcgttttgtttattttgtgcgctgtcctcttccacatcttcatcttcatagtgaatatcgaacagatccagagtggatggcccgaatatatcgtgcagatacgcataaatctcacgattgttgatatcccggttctgcttacggatgatatttttctttaaatccacacgaacctgattgatccaggcatcaatatcatcggattcctttttattgacacgtattttttcgtaaaaatatcccatgctctgaagcatcagtttccggttgacatcacggatccgacgtggaatttccagcagttcgtcctcattttcttccattttctgattggtttcatcaatcagacgtttatcttcatccagctttttttcccgctgtgcatccatatcttcggatgtagttccgtccatgtttgcgacaatgctttccatcagctgcttttttacttttttcagctgttttaactcttcattcagttttccctgtctggcaagcaaagcattcagctcgttttccgtttcatgaatttcgtccggcttgccatgcacagcaaaaagccgatgccacttctcatcaagtacaagaatcggcacctgtttgtctgccagcgcttttttaaattcttcatcatccttcatcgtatcacctctttgtgtgctacttggagttcttcacgatattatatgataactgcatcagactgtccgacaaatgaacattttcgacaaccacacttttatcacttaaatccagatccacatgggcaaaattccagatggcacggattcccagattcacaagatgctgcgcagtatcttctgccttttctttcgggagtgttaaggctgcaatatctactttattttttttgcagtaatcatccagttcatccatcatataaatcggaatatcacgaacggtctgtccttttaaagatggttttacatcaaacaacgcagtaatgataaaaccaaaccgttcaaattttacataatttgtaattgcctgaccaagatttccggcaccgatcatgataatattatgggtctcatttaaccccagtatttttccgatctcatcatacaggtatttcacattatatccgtaaccctgttgtccaaatccgccaaaattattcaaatcctggcgaatctgagaggccgtcaccatcatccggtgactcagatcattggaggaaatgcgctcaacgccttcctccagcaattctcccagataacggtaatatcttggcatacgacggatgacagcttgtgagatttccttttccacaatttcatcctccaatccttttatttatgaaagagaagcttccagttctgtccggattgccttaataaaattctcactgtttaataccaccggattttcaatggtcgtaatcaaagcaagatcctttgtcatctttccggactcaatggtctttaagcatgctgcttccagtttatccgcaaactcacagagtgcctgatttttatccagttctccgcgctttctgagtgctcctgtccatgcaaaaatggttgcgacggagtttgtggaagtttcttcacccttcagatgcttataataatgtctctgaacggttccgtgtgcagcttcatactcataatatccatgcggggatacaagtacggaagtcatcatggcaagagagccgaatgcagaactgatcatatcactcataacatcaccgtcatagtttttgcatgcccagataaatccgccttttgacttcataacacgtgcaaccgcatcatcgatcaaagtataaaaatactcaattccggctttttcaaatgcatccttgtaattcttctcaaatacatcctggaaaatatccttaaaggtatggtcatattttttggaaatggtatcctttgttgcaaaccacagatcctgttttgtatccagtgcatatttaaaacagctgtgtgcaaagctttcaatggaatcgtccaggttatgctgtccctgtaatacaccggctccggtaaaattatggatcagctcacgcacgatggttccatcctctgcagtaaataccagctcagccttaccaggtcccggaaccttcatttctgatgccttatacacatcgccatacgcatgtcttgcaatcgtgatcggtttttcccaggtcttaacatttggctcaattccctttacgacaatcggcgcacgaaataccgttccgtcaagcatggcacggatggttccgttcggactcttccacatctcttttaaattatattctgtcattcttgcggcattcggagtgatcgttgcgcattttacagcaacaccgtatttctttgttgcatttgcagaatcaaccgttacctgatcgtttgtccggttacgctcttccagtcccagatcataatactctgttttcagatcaataaacggaagtaacagctcatccttgatcattttccagagaattcttgtcatttcatctccgtccatctctaccagtggtgttgtcattgtaatcttgctcatcgcttcattctcctttattttatttcatcagattttcccaaccgactttatccatgttggatatcgtattgcggatatggagtctggcacactcctccgctgtccgggcatcccttgcctttaatgcctcggcaattgcccggtgttcattgatcgacgcatgagcccgtgctttctcttccagtgtgatccgccggatgcgctgcagataatgatgatagtcacgaagcacacgtgtcagttctttgcttgcgcatgcctcatataccatttcatggaaacggttatccagttccagtatctgatcccagttttctttggaatagtgaaaatcggataaaaatacgatttcttccagttcctccaactgttcctgcgtgatccgctccgctgcccaccgggcacataatccctctaaaagcgtccgtatctcatagatatctttgatatcctgaagggtaaccccttctacaaacgctcccttgtttggaatgatatgtaccagtccttccagttccagctgccgaagcgcttcccggacaggagtccggctcactccaagatcgtcgccaatattcttttccttcagttcctcattcgcctgatattttccatttaaaatatcttcccgaatggaatgaaaaactttggcacttaatgaataatgatcttctgccataatttcaccttatataatatcgaatttttgtctataacacaataccaagctctttacaaacggaagtaatttctacaacaagttcctgatccgtcataaccgtcacgcgtccgtcatcgtattgtgtgtctacccagtctttgatccggtgtacaagttctgagtttttgtccactttccggtcatccggtaaatgataataattgttgatccagtgtgcaatacctgccagacctgaggtattcgatactgctaccagaggtggacggtttaaaaattttccggtatcgaaaatgttatagatttcctcgtttttcagtaatccgtctgcgtgaataccggctcttgtcacattaaagttacttccgacaaacggcgtctgcggcggctgtttgtatcccagttctttttcataatattcggaaagttctgtgatcacggtcgtatccatgccgtcgagagtgccgcgcagctgggcatactcaaataccatggcttccagaggcgtattaccggtacgctctccgattccaaacaaagaacagttgacaccacttgctccgtacagccatgcagtggtggaattgttgactgctttgtaaaaatcattgtgtccatgccactcaatctgggaagaaggaactccggcatgtgttgtcagaccgtaaatgattcccggcacacttcgcggaattacggcaccagggaagtttaccccatatcccatcgtatcgcaggcacgtaccttgatcggaatcttgtactcatcctgcagtttcatcagttccacacagaacggaattacaaatccgtaaatatcggaacgtgtgatatcctcaagatgacagcgcggactgatgccggtctccagacagtcgcggatcacgctcaggtacagattcataacctcccgtcttgtcattttcattttatagaaaatatggtagtcagaacagctgacaagaatgcccgtctcgcgaagacccaggtctttgaccagctgaaagtcctgtttgctggcacgaatccaggaagtgacttccggaaactgatagccacgttccatacatttatataccgcgtcgcggtctttcttactatataagaagaattcactctgacgaatctttcccttcggaccgccaagtttatgtaagtaatcataaatcgtcacgatctgttcggtggtatacggagcacgggactgctgcccatcacggaatgtggtatctgtaatccagatttcatccggcatattatgcggaacaatacgatcattaaacgcaatcttcggaatctcctcatagggaaaaaggttccggaatgtattcggttcatccacatctaccagctgataaaaatgttcttcgagctgcaacaggtttgatttgtcattcattactacttctctcatgtgctgactactccttttcatacatgaataattgtatacaattattacgttataaaatcattttatctatttactatgtgaaagtcaatgaatttttttagaaaaatatggaacccttttgctgccgtctcatacattatactgtaaatatatttatttggaggtcacttatgagtgatttaactgctacaaactgtggatgttcaacagataacggatgtggatgcaattctattatctggatcattcttcttctctcctgctgtggaaatggatctttctgcggaaacaacaacggatgcggatgcagtggcggcggaaacgactgctgctggctgattcttcttctgttattctgtggcggatgcggcaacggaaacggatgcggcggaatcttctaatatttgtgttagaaacgtgcgcagcaaggtgcacaacccaaaagggatgcagtatctgcatccctttttgcatataaaatgctatccttcttttgtggctttttctttctggatctgacgttccacagcctcttttaccctgcattccgtgggaacattccgtcgtttcaggcattcttcatccacttcataaacactgtttccatcaataatcagtctctcatgcatctgttttttcctttttcttttattgtattcatacagacaggcattctctcataaaataatagaaaaattatataggatgtgttatccatggatgaaaataaatccatcacgtatgacgatctgatccagacgagaaatacgcagatcttaaagtccatcgtaccgtttttagatgttccgacacaaaagccgcttgccatgctgatccagctgatggaatggaaaaatgccacagcagctttctccagacaggagaacagcatggctgcctgttcccttcctgccggtaccaaacggcgggatgcaatgcttagtgcagtccgtaaatattgtaccccaaaagaacaggaaatgattgataccatacagacactgttttgtattatggaaaatcaggatctgtttcacaatccataaatctgcaggaggtttttgaatggattccaatctttttaacaatccggcgtttgccagtttaagtccggaaaaattgcaatttctgctctcctttgcacagaaagaaaaacctttaaacatgaaagatgccatgccgtttcttctctcaaatatgaggcaggcaaaggaaaaccatattgatttcacaaagcctgaaatcgaactgttgtgtgatctgctgtccaaagaccttccgcctgagagtcagacacaaatgaaaaagatcatgtccctgatgtcgatgaaccgttcacatccagctccctgatcgggatttttaaaattttatccagcgggaacaggcttttgcctttcccgtcggttccctcataatatttttctcctgccgattcaaacagaatatataaggtattgtcccttacatcgagttcttccgatgccggaggcatttccactttctttctcggatgtttcggccgggttgcgagtgccgtgacagagtcgtaacaatataaataggaagactggtttcttccgtaggaagtgctcagatatacgtttccggaatcatcgaacgtaactccctgcaccttttgcggaattttataatcactgagggcaatcagtttgtccgtctttttatccagataatatgccaccattcgtgaattcaccagaagtgtatgcgttgcaatccacaatcttccgccataccaggtaatacaggaaggcgtatttttgaccggaaactcatccacaacatctcttgcatccacgacatctccggtattctgataggccatcagttcaataaaatcgtaggagatccgctccacacagttttcataggaattgcacacccatacattgtcaccgtcaaacgcaattcctcccagatggctgttttcatccattcccagtgtgaccatatattctccggtttcccggtcaaacaccataagctctcccatacagtcatcttccgtggaataagaagtgatcagcacaaattcgtcggtcagacaaatcccctgcgggcactgggatgcactgaaaatatatttttttaacacatcctcctcccgggtatccggcatgcccggaatatcaatttcattgtaaaagctgtaatcaagatctttcaacagaaccagatttttaccgaagcggctctctcttttgtgatagttataatattctacattgtaataattattaatctttgcggtccatttggcataaagaatgtaatgatccttacgatccgtgggaatggtctttatctgtttgtgaagcgcggcatcggagtaccatccaagaaaccggaatccactccggtatggcgtatacagcggctgctccccgctgaatgccgggtacgattctttattgaaagaattctgtatgccgcctcccagaaaataccccacggtaaccgtatcgttctttgtgtgaacatttgcaggtttttgaaaggaagaactcgaaggggcataattctccccttcgagttctgtgttttttgcatatgtcggtgtcacgataaaatttaaggttattgcaatcaataatacagcaaacactgtactattcttctgtctccacaactttgcctgccctctcttctatttctcttgctgccacatcctcaggtgcttgttcataccgggcaaattcataagaaaatgttccgcttccgctggtcattgaccgaagctgtgtattatatccatacagttcaagatatggaagatccgcatcgatctcctgatacccgttttctgcattcatattcatcacacgacctctgcgtttattcagatctcccatgatttcaccggtatattcctccggagtaatgatctttacagaggcgatcggctctaacaataccggcttcgcatctaaaaatcctttcttaaatgcctgtttcgcggctactttaaatgccatctcggaggaatccaccggatgataggagccatcatagagtaccgctttcactccgattaccgggtaggccgcaagcggtcctttcaaaacagcttctgcaattcctttttccactgctggaaaataatttttcggaacggctccacccacaacacactgttcaaatacataaggaacctctaaatccccgctcggctcaaatttcattttaacatggccgtactgtccatgtccaccggactgttttttatatttgtattcaacatctgattttccacgtatggtttcgcggaaagcgacctttggacgcatcagttcaatttctactttatacttttcaagcagcatactctgaacaatttcaagctgctgctcacccatgccatataacagagtctgacgattttcactgtcatttaccacacgcagcgtctgatcttccatcagaatcttttgcagcgactgggaaatcttatccacatcccctttgttttttgctttgtagcgcatagatacatacggttttgagaaattcgtgcgaagataggcaaccggattattccgtacggacagggaatccgttgtctgggactgggacagctttgccagtgctccgatatcccccgcatgaagttcttttacttcctctgttttatttccgcgcagaacgtacagctttccaatcttttcgtcacaatccctgtgataattaaataagacatcatccgtcttaagcacaccggaatttactttgatcagagaatactttccaatgtaaggatctacaattgtcttaaaaatatacgcactcttcggttttgcgaaatcatagtccgccggatacacctcgttgtttgtcgtattgatgcctgcgcaggtccgtttgtccgggctcggaaaatatttaacaatatctgccatcagcgtatacatcccgcgggcaagcggattcgatcccataagaaccggaacgatagaaccatccatgacatttaccctgagcgcctgacgaatttcgtcctcggagaattcatctccgttaaaataacggtccataaactcctcgctggtttctgccacagcttctaacaaagcttccctgcacagattaagattcttttgggaatattccggaacttcaaatttttcaacggttccctcatcgatccatcgctttgctttctgctggatgacattgacatatccgacaaactggccatcctcccggaccggcagatgaaacggtgcaattttctttccgtaaagagcctgcagatcttccactacctgacggtaacttgcattgtcaatatccatatctgtcacaaagatcatacgtggaagatgatttttttcacagatttcccaggcgcgccgcgtgcctgtctcgattcccgcttttccggaaataacgataattgctgcatccgctgcggaaactgcctcttcgacttccccgacaaaatcaaaatagcctggggtatccaaaacattaattttgttgtctttccacgggatcgcgaccacagaagtatggatcgaaaactggcgtttcgtctcctccttatcaaaatcactgatggtatttttatctgcgaccgtccccatacgtgtcgtcagacctgccagatatgccatggcttccaccagggaagttttgccgcatcctccatgccccaggagaaccacattacgaattctgtctgtcgtatatacgttcatagtaaaaccctccttttttagaatatttactcttttatggttatattctactaattttcagaaagttttacaacctttttatgcattttgttgaagtatttttgccgcaagttcttccagatacgtccagcgatccattttttcttccaattgtgtttccagctgcgttttttcttctgtcagttcattcagcttcacaaaatcccgtgcgcaggatgccatctccccgtcaatctctcccagccgtgtttccaaagctgcaatgtcgtcctcaatggtttcatattctttctgttctttatatgaaaattttaatttattttcatgtttccatgtagaacgtgaatcttctgtcgcctgtttttcctgtacatttgccgtctcttcatttttacggaacgaatcgcctgcagtatctacaaattttccttcctcttcggcccgtctgtggtagtccgtatatccgccctcatactggcagagctttccgtttccctcaaaagcaaagattctgtgcaccacacggtccagaaaataacggtcatgcgataccgtaatcacaataccgtcataacgatccagataatcttcaagaatggtcagtgtcgtgatatcaagatcgttggttggttcgtcaagaatcagtacattgggagcttccataaggacccgcagcagattcagtctgcgcttttctccgccggacagttttttgatctgtccatactgttcttccggtggaaacaaaaacttatctagcattgcggatgccgaaaccagtccatcttctgtgcgtacatattctgctgtatttttgatataatcaatcacgcgaagctttgggtccatatatgcaattcccgcattctcatcctgttcgatctcctgtgtgtaatatccgatttttatcgtctgtccaatggttacttccccagcatccggcaaaattctgccatcaataattttcataagtgttgtcttgccgcatccgtttttcccgacaaaaccaatccggtcattttttaagaagatataggaaaaatcagaaatcagtacatgatctccatatgtttttgtaatatgtgataattccacggttgtttttcccatacgggaggacaccgaaccgatttcgatctttttatcaacatccggctttttttgatcccgcaaggtctcatagcgctggatatgtgctttctgtttggtggaacgcgcccttgccccgcgctgcatccattcgatttccttgcgcagaatggactgtcttttccgttcgcctgcccaggcaatgtcttccctctcctgtttggccgcaagatatccggaatagtttgtctcatagctgtaaatctgtcctttatcgacttccacaatccggttgcatacactgtccagaaaataccggtcatgtgtcaccataaccattgctccccggtaatttttcagataattttccagccactctgccatttcggcatccagatggttcgtcggctcatccaaaagcagtacatcacacggagtaaggagcactgcaacaagagccagtcgtttccgctgtccgccggacaaatgtcccaccggttcatcgaaattgtatatgccaagccgcgtcatcatggatttggcattgctttccagattccatttttcatgttcttcccggtcttcctgctgatgcacacttccaatctgcgcataagaaagtacattctcaagtgctcctttttgcgggtcaaattccggcatctgcggcagatagcgaatcacaagatgattggcccgtacgacatttccggcatccggttcttcgagtcctgccataatttttaacagcgtggattttccggttccattgatgcctatgattccgactttttccccatcctgcagataaaacgatgcatcgtgaaacaactcacgctgtgtataaacttttgtaatatgatcaacggtaagtaaattcataaaaattcctctttctgcttcctttcgcctttttattatcacacgaacggacaattgttgcaagtgctgtcacacattcctcttttgacactcctgccattctatagtacaataaacacatcaattacataatataaaggaaataaacttatggcttttcaaacaatcggttttatcggactgggtctgattggaggttcgatcgccaaaaaaatgaaatccaatcagccggacatcaaaatttatgccacggcacatcataaagaaaccatcgaagaagcgtaccgtgaggggctgatcgaaaacaatgatctgttaccactgtctgctttttctgactgtgattatatttttttatgtgccccggttcaacggaacctcgcatatctgcgtcagttaaaagatattatccgcagcgactgttatatcacagacgtcggaagcacaaaaacggaaattcatgaagaagtgatacggcttggcatggaggccaattttatcggcgggcatcccatgaccggttccgaaaaaacaggcatattaagtgccaccaatacgcttttggaaaatgcatactatattatcaccccgaccgccctgactccaaaggaagaaatttcggaatttcgtgattttgtattgtcgcttggagcaattccactgattttggattataaaatacacgattactctacggcagccatcagccatctgccgcacatgatcgcatattcgctggtcaatctggtccaccagatcgatgatgacaaagaaaccatgaaaaccattgccgcagggggatttaaggatatcacaagaattgcatcttcttcgcctgtgatgtggcagaatatctgtgcttccaaccgggaaccgattctttcactgatggatcagtaccttgccattctgacgaagcttcgcggatacattgacagttccaatgaacaggcactgctttccttctttcagcaggcaaaagactaccgggattccatcacactgccaagtgtcaaatcccctacggtatattatgaatgttttgtggatctggtcgatgaaaccggcggtattgctgctgttgccgggctgctcgcacaataccatatcagcatcaaaaacatcggtattgtaaataaccgggaatttgaagaaggtgttcttcagctcgcgtttcctgacaaacagactctgacccgtgccaaacgtctgcttaccgacaatggctatatggttcacgaacggtaaaacataaatggttttcccataaaaaatacaggctccggataatttccggagcctgtatttttatttgcacaaggtatcgagtatttcaaaatagttttcaaacgtcttcctgcagcaggaaggattttcaatcacaataccgtctgtcacaagtcccggaattgcaaaagccatcgcaacccggtgatcctcgaacgtttttattttacatccatgcggttttcccggatgaatcacaatacggttctcatccagctgctcgcatgcgattcccattgccttcagattggtaagaatcgcggcaaaacggtcacattcctgataacggatatgtccgattccggtaatctcgacggtttcactggcaaaacacgcaattgccgccagtgtcagtgcctgatctgaaaatgcagaaaagtcaaatacccctcccaggaatccttccgtcggcggatacatccggattccatccggttcttcctctgtccggcatcccatctgttccagcacatgtaaaaaagaagtatctccctgtaagctttcccagtgtacatggcagacctttgcaggaacaccgacaaccgggcacatcgcataaaaataagaagctgccgaaacatccggttcaatctgatactctcttgcctgatatgctgtatgttccgcaatcacaaaagtatcggatgcaggtcgttgtacttccacaccaaactgtttcatcatagcaaccgtcatctctacataagccattccatgatgccctttgacgtgaatccggaattctttctgaaacaacacggaagagatcagaagcgcactcagaaactgactgcttttttcaacatcaatggttacttcgtgtctattcacaccactgtttccgatcacaaatgggaaatgtcctgatgcttccttataagtaacttccgccccaaggtcttgaagtgcctgcagcaattcttccatcgggcgctttttcatctgctcggaagagttcatatgatattctccctcacacagaccaaggtatgccgtcagaaaacgggcagcagttcctgcacttcccacatcaacggaagcttttgtctttggaaccctgcccccttttccttcaatggagacaaccgcatgcggctcatcaatttccaccacaaagccaagatcctgcaaagcctgcaggaaatgcctgctgtcatccgaaaaaagaacccctttaagaacactctttccgtttgcaagtgctgcaatcagaagtgcccggtttgtaatgctcttcgatcctggaaccgaaacctcaaccggaattatgtctgctttttttacctcataagtatcctgtaagatcatagtttttcccgccttattttacagttcgttaaaaatctgatagatatcaatctttaatgcatcggtatccgtcattccgataaacacaccgccataatgaaatccgtccggcttttcttcgctgcggacaatctggatgactgcatccaccacttcttttgtccatatctggatctttgcatcataataggaattcatttccagtttctttttacagtcaaatccaattccgctttttgaaatatctgttacatccacatgcacaaattttaaagttgtgaccccgtcttcatccagacgctccaactgtacattgacatccagatccagtcttttatttttccttttttcttccattttccatccccttataccttttcaaacgataatataaatattattttattacattcagaaacacattacaagtaaaaaaagggatattccgggctcccttcccggaatatccgataaaaagtaatgattttataaaagtcccgcctgcaccagacgtccgtgaatctgcggtccgatccatgcagcaagaaccattttgataatgtcaaatacaataaacggatagacgcacattgtcaacgccgcctgtacagaggttttcattaccagtacaaaccataccgttccaaagatatagcaaacagcagttccgagaatcatgccgatcatgcccaataccagtttccgtccggacttttcaataaaaattccggcgatcacagccatcggaataaacccgatcagatagccgcctgtcggtccgaacatttttgccggacctgctgtaaaaccggaaaataccggaacgccaaccagtccgatcagaaggtaaacaatatagctgaccgtctccctccgggtgcctaaaatataaagcccgaaataaattaccagattggtaagagaaatcggaacatctccaatcgggatagacaatggtgctaaaatacaggttacagctgtgagaacaccgatcacagcaatggtttttaccgacattttctttggtgtcgcgcttacagtgtcattcatttttttcttcctttccatacgaatttaccgtgttaagtatacacgcatgactttttattgtcaaccgtctttttatactagttaacaattacttttaggaaaaattattgcgatatatgtaaacaaatgctaatataaaaaaatagtttagggttaaattatgcgaaaaccattataaaagattgtgggttaaacactatgacagatcattctatttcagaaaaaattgaatataatgttcataaaaaagaactgtcacaaaacaggaaatggatgtttcctttttgtaacagttctttttatgattcttttattgaatcagcatagcatcgccaaagctaaagaaacgatatctttcttttacagcgatctcatacgcatgaagcacatgctcccgtcctgcgagtgccgatacaagcatcacaagcgttgactgtggcagatggaagttggtaatcagggcatcaatcactttaaactgataccccggataaataaagatttccgtccagccgctggtctcatgcagccgtccgttttcatctgcagcggcttccagcgtacgcgtactggttgtgccgaccgcaatcacccggtgtccgctttccttcgcgcggttgatcttatccgcagcttcctgtgacaccatataaaactctgagtgcatatggtgatccagtacattttctacttttaccggacggaacgtgccaagtccgacatgcagggttacttctgcgatatcgactcccatatcctttactttctgcagcagttctttcgtaaaatgaagccctgctgtcggggcagcggcagatccgtcatactttgcatatacggtctgatagcggtttttatctttcagctgatgcgtaatatatggcggcagcggcatctgtcccagctgatccagaatctcttcaaaaattccgtcataatggaactgaatcagacggtttccttcttctactacatccacgacttctgccgtcagaagcccgtctccgaacacaagttttgtgcccggttttgcttttttccccggttttacgagtgtctcccagatatcattttccttgcgttttaacaaaagtacttcgatttttgcctgtgtgtcctctttcactccgaacagacgtgccggaatcacctttgtgttgttgatcaccagacaatcacccgggtgaagatattccagaatatccgtaaaatgccggtgttccacgtccccggtctgacggtcaagcaccatcagccgggagctggaacgatcctccagagggtcctgagcgatcagttcctccggcagatcatagtcataatcttttacattcattccttctgtcatgattaacctctcaactggattccgatatttttcagtccgtttaagattttatccatagcacccgtaatatcgctctcttccagattcttatcttttccgcggaacttcagagagtatgcgacagacttaaagcctttttcaatctgctctccttcgtatacatcaaataactcataattttccagatacttaccaccgttttcctcgaatactttctcgatatcacctaccagaatattctttggaacaaccatggacaagtcacgggaagaaaccgggaagttggtaattccctcatatttgtaatcaaaggatgcacgggatacaatctccggcatatcaatcactgcaatatatacgcgctctttgatggcataatttgcagcaaccgttggatgtacctctccgagatatccgatcacagctccctcatatacgatagccgccttgcgtcccgggtgcaggaacggaagctcggcatgtggatcatactgcgccttcttgcgaagacctgtctggtataagagttcctcgatcacacccttcatggtaaagaaatcaccgtctccgtacataccaaaagtcagctgcatacgttcttccggaagttccgtcaacggaagctgcttcggcagatagatatttcccatctcgtacaggcgtacatctttgtttctgcgtccaaagttcgtagacagggaagtcagcattccgttcaatggcagcgtacgcataatggaataatcttccccaagcggattggaaatcacaaccgttttacgccacttggaatcctccggaatcagtaatttgtcaaatactttcggactctcgaaagaataagtcattgcctgtgaaaaaccacagaactctgcaatctcacgtgccttttcttccatacgcagcttaaagctctttcctccggcagtggattctccgctcggaagagaagttccgatcttgtcatagccgtagaaacgtgctacttcctctgccatatctgcgtcacaaagcagatcctgtctccaggacggaacaagaatctcattcgttgcttcgtcatatcccagatctatttttttgaaatatccgatcatatccccggccggaatatccgttcccaaaagcttattgtacttgtccggttcgaacggaatctttacgccctcacgcttcacaggataaatgtcaacggctccacctacaacctcgccgacgcctaactcttctaccagctggcaggcacggttcatcgcttccatggcaagatttggatctaagcctttttcaaacttagccgaagcatcggtacgaagtccgatgcgctttccggatttgcggatattggttccatcaaagcatgctgcctcaaataacatggttgttacatgatcggtaatcatggaattttctccacccatgataccggcaatgcctactgctttttttgcatcacagatcatcagtacattttcatccagctgacgttcctgtccgtccagcgtcacaaatttttcacctgcagctgcacggcggacaataatctcttttccttcaatcgtatccagatcataggcgtgcatcggctgtccgtattcttccatcacataattcgtaatatctacaagattattgatcggacggattccatgtgcacgaagacgttcctgcatccacttcggagatggggcaaacttaatattctttacaactcttgccgtgtaacggctgcaaagatcctgatcctttacagatactttgatgtaatcattgacatcttcgttatttccggtttctgttacgacaggaggtacaaattccttatggaacgtagctgctgcctcacgcgcaatgccgagtacggaaaaacagtctacacggttggatgtaatctcatattcgacaacgctgtcatccagtcctaaataagcaaccgcattttctccgacaggtgcatcctcgtcaaagatatacagtccgttctccggtgcgtccgggaacatttcacggttcgaaccgagttcctcaatcgagcacatcatgccagaagactcaaccccgcgaagctttccttttttaattttgattccaccaggagtttttgttccatcatgtcctcctgcgacacgtccgccatctaaaacaaccggaacttttgccccttcaaatacgtttggtgcaccggtcacaatctgcagcgtttcgcttccaacgtttacctggcagatgacaagtttgtcggcatccgggtgtttttcaatctttgtaacctgtccgacgacgatcttgtcaagatctgcatcgagctgctcatatccctcaacttttgatccggaaagtgtcatggcatcgacatactcctgcacgccgcagtcaagtcccggaactaaagctttgatccattttaatgatgtattcattctttttctcctcctagaactgttttaagaaacgatcgtcattctcatacagcagacgcatatcgtcaatctcatatttcaacagggtaatacgctccagaccgataccaaatgcaaagccggaatattcttccggatcaataccgctcatacgaagcactcttggatgtaccattccacagccaaggatttcgatccatccctcacctttgcagaaacggcatccttttccgccacatttaaaacaggaaacatccatctcggccgatggctccgtaaatgggaaatgatgcggacggaattttacttttgtttcttttccaaacagcttctgtacaaactgggtcagtgttccctttaagttagaaaacgtgattcccttgtcaatgaccattccctcaatctgatggaaagaaggcgaatgggtcgcatccacttcatccgcacggaacacacgtcccggtgcgatcatacggatcggaggtttcttctgctccatcacacgcacctgaaccggtgaagtctgtgtacgcagcaggatcttatcattgatgtagaaggtatcctgctcatcttttgccggatggtttgccggaatatttaatgcttcaaagttgtaataatcgtattccacttccggtccttctacaacttcatatcccataccggtaaaaatacgctctacctcttcaagtaccatggtattcggatggctgtgtcccacacggtttttctttgccggaagggtaacgtcgatcacttcattttccagacgatgttcaagctccgcagcctcgagttttttcttcatctcatcgagtttattttcaatttcctgacgggtctcatttacccactgtcccaccttcgggcgatcctccggtgcaacctctttcatactctttaatacggcggtgagttcccctttctttccaagaacggcgacacgcacatcgttgagttttgcaagtccgtcagaattttcaatctgtgctattgcattttctctgattttctgcaatttttctttcatggtactctccttttacatattttctttcataataattgtttttacgcaattttctactgtggaaccggaactgttttctggcataaaaaaatccctgctatgcataattgcatatcagggacgaaaaattccgcgttaccacccagattcccatatcctgtatctatatggactctcattctgcttaacgtgcagtgaccgtcgcaggctaaaaatccttgtgttcacctgcgcagctcctgtgggaaaattcacatgctggcgtatcataaggaagcttacagccgatgacttcctctctctgtatgtcgttcagatgctactgacacattcattgctttttacacatttgtcattttaccacagtctccttttatgtgtcaagatcaaagacattggtaaatgtaacatccttaaaataaaatccgagaatttcctgccatttctttccttctttccccatggcgtccgcaccgtactggctcattccgattccatgcccgaatccgcctccggtcagcacgatggttccttttttctgactttttatttcaaaacacgcactcgggacggaagaggcacgatgtttattggttccgtctgcaagatcaagatccagcagatactttccgagtgcataccggatttcattttccttttcgatcgtccgctctcctttttcaaaaaccatggtaagagacagtacatatccggaagtgcttcgtttattgactttcagttttttcagttttccatatgtttcatccatgcccagctttgccgacagggtagccgtccatcggaaatacggggaattttcatcataggcatccgcttttgctgtaataaatttatgaaaggctttatccgaagacagatcttttgtcttttccctggtatggttttccgccagcagatatcccggagatgcggcattccatacttccagattttcagaatatcccggggaagtggaataataataacagtccgcaagttttcctttgtacgtcatcaccatacctgcggtatccgccacagcctgatccgtcacttcataggaagttgttgcatgataggcctgataggcaatggaatcatccagatttgctccgtaccgggcataagtatcgtttttcatctgcccgtatgtaaatgtgcgcgcacataccgcctgtgcttttaaggcttcataggaaaaagataatggcatttcagaaggcagaacataacgaatataatcttccatcggaatttcattgatcaggacatatccctttttttccttccggagaatcagatctccctcgtacccggaaccatacgggtttccgtttttatcacatcgatacaaaaggccaccggtatccggagaaatttttatctcttttcccgttttttcccctttcagaaatttttctgcatctgttacggtgtccttcttccttttatttccatccacggtataggcatccccgctgcaaacaaaaagactggcatatgtattttcttttccgtttttgagcagcacacggaccttttctgccatgtcctcctgatagcttacaagtgcacaggctttctgctctgcaacaaccagttccactttggaatttcctacaacaagatctgaaatctttccctgacggacaggaatttttgcatgtccggaacttgccacaagatacaccggcagatctttttctgccgaaagcggttcatatccctctatctgaacactttttgaggagtaacttgtcagaacccccttgatcgttgaaggtttcgcataaattttagtaacctttcccttcgtcagttcaatatccgcaacccccgtatattttttctccggctttccctccgccaaataggtttctccccgatataatacaatgatatccttttcttcactctttaagatatatgcattgctgagcatcccggaaacggaacggtcaaatgtttcttctttttgatctttccctgccgttttggaaagacgggataccagaattaaagtgatcgcaacggtaattaccgcaagcagcagaatcagaatccccatcatcttcattttgtctctttttttcatgaagcactctccgtttttattaattcatctgtcattgacacaaaataaggagccaccgttctccggcagctccccttctcttttgtacgctgtaacattctttggtatataataaattctttggtattttaatattaaatactttttctttggtatgttacccaaaatgccggttcctgcaatttagactcctagccaatgctaggtgggcgaccgcagtttcccttctgtcttccgctgactgtggcggcctgacatccagaaaaatcatataggaatcccgtttaaagtaaatgtaggttctaaatagcaagagttgtcgtacatttcaggcatctctttctgccgtcttttatgcgataccgcatccggcaactttctcttttgtactgcatttattatactttatttttacctgaatttcaaggtctgattctatgtacttttttccatttccgcatactgctttaaggaaaaaatttgtcttttattttacgcattccgcttacaaatgcaaacaatgctgccaaaaatgcaccaagttccacatatgtccagatgcgtccgagcgtaatcaccttaatatcacataaaattccgattgctcccacaacaaccgctaccgccgcaaatccatacagccacggtgttattccccggatatacgcctcgggatctttacacttcttaatttcttctttcgggacaaccaggtcactgatctgtccgctttttttcatttttgcagcagaaacagccagataaatgcctacaaaaacgatcacaatatccataagtaaaattgttttcatgatttttcctcctgttttatagtatcacacacgaaaaaactttttaccatcggcaaaaatagtcaaatttcattgattattttatacatttatagtaaaatatacttaatatgtaacaaaaaggagaatgtatatgcgcattgaggacactacaattttaattactgacgattcgattcttgcacgtaaacagttaaaggacatcatttccattctcggcactccagtattcgtggaagccaccgatggacagagtgcgattgacaaatataaagaagtacatccggatctggtatttcttgacattgttatgccaaaaaaagacggcaatgatgccatccgtgatattatggaatttgatccggaagctacaatcatcatcgcttcttctgtcggaacacagtcccagctgaaaaatgcactggaagcgggcgcaaaagatttcattcaaaagccactggacaaggaacaggtgcttgctgtcgttaagcgcttcctggaagggagataatcgttatgtatacacaattttttggaaattatctgcttgccaacggatatgtgacccgtgatcagctgttttcagcgatgcgtcaggaagcagatcagcatatgaaactcggtacccttgccattcatgccggatacatgaatgcagcccaggtagatgatgttgtcattcaccagacccaccaggacaatcgtttcggtgagctggcgattcagctcggatacctgaccgaagcccaggtggaagaactgttaaaacagcagacccctgccttcctttctcttggacaggttcttttggatgaaggagttctgacaaacaccgatttcgaacagatcatacaggattaccgttccaaaaacggcatggaagatgaagaaagccttatcgagcgccggaaaaatatccagcagttgtttgaaaactttttttcatcaaccgacgctgctctttcggaaaaaggacatatgtttatcgagcttttatttaacgattttatccgttttatcggttccgattacacaccgctttccgtggaagaagtcactgaggcttccattgcctgttgtgtaaagcaggaaattcatggtgactatgcgattaacacctatatttccatggatctggacacggcgattgcctttgctacccgctatgtccatgagcagttccattcttacgatgaatacgttcaggcttctctggaggattttttgaatctgcagaacggattattcattgtaaatgtatcaaacacctctaacacagagttaacactcggtgctccggagcatattaccgtttccccgattcagttttcaggacgcaccttgcatatcccggttctgtatacgtttggaacgattgatttttatatggaacgtgtttccattaaagaataaaataggattttccttaaagtaaaatgccataaaaaacgtctgccacaaggcagacgtttttttatgtttccactataatactttagaaaggaactcgcacaaacgtggattttccgggtgggagaaaaattccttcggtgtattctcctcctgaatctgtccttcattgatgaacattacacggcttgccacttccctggcaaatcccatctcatgtgtgacaaccaccatcgtcattccatctctggcaagttctttcataatctcaagtacttctcctaccatttccggatcaagtgcagaagtcggctcatcaaacagcatcacatccggattcatagcaagtgcacgcgcaatcgcaatacgctgcttttgtcctccggaaagcattgcaggatagacatccgctttatccgaaagccctacgcgtaccagcagttcatctgcacgtttcgaagcctcttcttttgtcatgagcccggtctgtaccggggcaagcatgatattcccttttacggtatggttgggaaagagattaaactgctgaaacaccattccgattttctgacgcattttattgatgtcaacggaagaatccgtaatatccgttccctcaaaaagaatggaaccggaggttggtttttccagaagattcatggagcgcagaaacgtagattttccgcatcccgacggtccgataattgcaacaacctctccctgcgaaatcgttgttgatattccgtttaataccttaacatggtcaaaagatttacaaagatctctcacttcgatcaatacatttttgttatcgctcatttgtccgcaacctcgtttccagtttgtgtactcctgccgtaaggatcattaccagtaccagataaatgaccgcaacgccgaataacggaagaaacgcatcatatgtctggcttcgaataatgtcaccgccttttgtcagatccggaattgcaatgtatccactgatggatgtctctttcaaaagtgtaataaattcatttgccagcgccggaaggacatttttaaatgcctgaggaagaatgatcagccgcatggtctgggtgtaattcaacccaaggcttcgtccggcctcaaactgtccctcatccacagacataattccggaacggacaatctctgccacataagccgccgaattcaatccgaacgcaatcactgcaaccagaatcttattatccagtgcaacgagaataatataatacatgatcagcagctgcaccatcgtcggggttccccgccatatggtcagatacactttacagataaaattcaggatattcagtccgccatgcttgtcatgtgtagaccggatgattgcaaccagaaatccaagaacaattcccagaataaccgcaagggctgcaatcagcaatgtattccccagcccacgcagcagatacagataacggtcgctctctataaaatcctgttgaaattttgcaataaaatcactcactgtttatcctccgaaacaaattatttgtttcttacaacgattacctgacaagcctttgtataggtatccgtaaagtcaatatttttcttacgatcctcatttaccgtgattccggcagcaccaaaatcagcttttccggaagataccgctgcgatgatcgcatcaaactccatatcttcaatcttcagctcatatccgagtttatcacagattgcttttgcaatatctgcatcaattcctacaatctgatctccgtcataatattcgtatggctcaaactgcgcattggttgccatagtaagtgttccgtttggatactcggttccgtccggtgtctcatatggatgctttccagcctcatctccgatataattgctggtgatggaatcaatggttccatccttttgcagttcttcaatcgcgctgttaaatttatcggtcagatccgaattgcctttggcaatacagatggcatactcttccggatcaaacgtatcggataaaatctttaaatcatcatttttttcaacaaaagcttctgccggctgctgatcaatgattacacagtcaatctttcctgtttttaatgcctgaatggcatctgcgcctttattgtaacgttctaccgtactgccatcattcttttcatactctgtggcatccgaatctccggttgtaccgagctgtactccgatttttttccccggaagatcatctctggagttcacactgttggcaggtacggatgaaccgcagcctgctgttgcagctgccatggcagaaacaagtaaaagtgaaatcagtttctttttcataatctttgtcctcttttcatatgtattttaaacaccaaggaattttttaacaacctgtggcatttcttccacttcacataccgtatcatgaagtaccggtgcgatacggatctcttcgatcgcctgtgggactttgacatttccgattctggaaagctcatctaccagctcaaagtcacccatagtatcgtatttcggatcaatcgcatccataacgcttcgggtaaacttaaacggacttgccgtgctggcaatcacggtctttgtctcggtatccccggtatccttcttatacttatcgtatacacctgcggcaaccgctgtatgggtatcaatgatatatccggtatcctcatataattttttgatggtctttgcagtctcttcctcgcttgtataatttccgtagaaatcagcaagctgtgcacgcatctcatccgtgattgcatattttccgtctgtggaaagttcttccatcatctttgtattcttttctgcgtcgtttccggcaatacggtaaatcagacgctccagattggaagaaatcagaatatccatggatggagaacttgtaagaatgaaatcacggtttctgtcgtatgttccggtggagaagaaatcatacaatactttgttctcattggatgcacagatcagttttgcaattggaagtcccatattctttgcataaaaagcagcaaggatatttccgaaatttccggttggaacaacaacgttgatcttttcatcttttgcaattgcaccatttttatataattttgcatatgcatatacataatatgccacctgaggaatcagacgtccgatattgatggaatttgcagatgagaactgataacctgcaacatcaagttctgcttcaagtgcagtatcattaaacatcttcttcacaccggtctgtgcctgatcaaagtttccgtggattccaaccacacaggtatttgcacctttctgtgtgatcatctgcttttcctggatcgggctgacaccgttcttcggataaaatacaacaatctttgtgccttccacatctgcaaatcctgcaagggcagcttttccggtatctccggatgtcgctgttaaaataacaatatcatttttcacctgattttttcttgcagaggtaatcaaaagatgtggcagaatggaaagtgccatatccttaaatgcaattgtcgggccatggaacagttccagataataagcaccgtccgcatctaccagcggtgcgatctccggcgtatcaaatttgctgtcatatgcttttttgatacaatcctttaactcatcttctgtaaaatccgtaaagaaacggctcatgacttcataagcagtctcctgataggacatatctgcaagtgtatccatcgggacatccagtgccgggatacgctccggtacaaaaagtcctccatcatctgccagaccctttaaaattgcctgggatgcagtcagttttactttatcatttctggtgcttgaatacattaattccattttttcttcctcattttacaaaaatttaatcataacgtttctcgtacattataggtaaaaaagtgggtggtgtcaatgaatttcctatgttatactactaaaataacctgtcagggcgaaaggagaatttatgttaaccggtgtatatcttgcgacaaaaaaagacaaaaccgtatactatcgctccaatatcacgcacaaaggccgtcatatcagcctcggaagcttccccacggaagttcaggcacatcaggcatacactgccgcctgcgagctgttatccggtacagaaaccatcgatgaggcattttaccggaccaaccagcttgcctttgaaaaaattgtttcgctgatcaatttccgggataatcatatgtatattcctacccccatctatctgcgcaaaaattatttcagttattatctgagtattcaccgggagttaaaatttgacattgatgacctcttctattacagcagccaccggattctgacgcgccagggacatctgtatgtcaatcactatggaatgcagcttacgcttctcggccgctacggcatcaaaacccacgcggtaaacggcagggatttttgttttgtcaacggcgatgaaaatgatttccgctactcaaacctcaaaatcatcaatccgtattttggtgtcgaacgcatcgacaaaaacggaaccgaacactataaagtacgtatccatatccacggcaacatcactgtcggtaattacacaaatgcgattgatgcggcaattgcctataacaaagccgtagatctggcgcatcaggccggcatatcaaaaaattttccggaaaactatatcgaggagctgtctgcttcgtcctatgccgatatttaccagcagatttccctttctcctacatatctttcttacctaaaaggacttccccgcaaataagggaagtcctctctgacatctttttattatttctggttgatataattgacaagaccttcgcagtcaataatcttctgcataaatggtggaaatgcctgtccctggaatttctttccggttgtcacatctgtgatgattccggaatcaaaatctacttccacctcatcccctgcctgtatttcctttgcggcctgtgggcactcaatgatcggtaaaccgatattgatggcattccggtaaaagattctggcaaaggtctcagcaatgacacagctgacaccggatgccttgatggaaatcggtgcatgctcacgggaagaaccacatccaaagtttttattggctacaataatatctcccacatgtacattttttacgaaatctttatcgatatcttccatacagtgtgtggcaagttctttcggatcggaagaattcaaatatcttgccggaatgataacatccgtatctacgttatcgccatatttaaatacactaccatgtgctgctttcatttcttatctgacctcctttttctccggcatcttctacattacttccgccgggcctgaaatctttccggtgatggcacttgccgctgcaaccgccgggcttgcaagatatacttccgaatctacatgtcccatacgtccgacaaagttacggtttgttgtggatacacagcgctcgccttctgcaagtactcccatatatccgccaagacacggtccacaggtcggtgtacttacgattgcacctgcttcgataaagatcttaagaagtccctcttccatggcatccagataaatctgctgggttgccgggattacaatcacgcggagtcctttggctactttctttccttttaagatttctgcagctgtacgaagatcttccatacgtccgtttgtgcaggaaccaatcacaacctgatcaattttcacatcgcccacttcatcaatcgtacgtgtgttatccggcagatgtgggaatgaaacggttgactttaaagttgaaagatcaatcgtatattcttcgtcatactctgcatccgcatctgcttcatattctacgaacggtctcttggaatgttctttcatgtatgcacgggtcagatcgtctaccgggaaaataccgttctttccaccggcctcaattgccatgtttgcgatggtaaaacggtcatccatggaaaggtatttgattccttccccaacaaattccatggatttataaagggctccatccacaccgatcattccgatgatatgaagaatcacatcttttccgctgatccatttgtccggctttcctacaatattaaatttgattgcagacggtactttaaaccatgcttttccggtagccatgccggctgccatatctgtacttcccacaccagtagaaaatgcaccaagtgcaccgtatgtacatgtatgggaatctgcaccgataatcacatctcccgcaaccgtaagtcctttttccggaaggagtgcatgctctattcccatctcacctacatcaaaatagtttgtaatatcatttttgcaggcgaactcacgtacgcatttgcaatgctctgcggatttaatgtctttatttggagcaaagtgatccatcacaagtgcgattttatctttgtgaaatacaccctctacattcatttttccgatttcatgaattgcaaccggagaagtaatatcattgcccagaaccagatccaggtctgcctcgatcagctgtccggcgctgacagaaggcaggcctgcatgtgctgcaagaatcttctgagtcattgtcattcccatggataattcctcctttaatatcttaaactactatgattttagcacagattatttcataatcctaatacataataaacatatttaccataactatattttatgatataataacttattataataaacggaggcaataatgaatcagaatttatcttcttactggattttttatacggttgccaatgccggaaatatttccaaggcagccaaagaactctacatcagccagcctgccatcagcaaatccattcagaaactggaagaaaatttaggatgcaaactgttttcccgcagttcccgcggcgttgtactgacggacgagggccagttactttatggacatgtaaaggaagcctttgaaacactgacacttggggaagacaaattaaaacgctccatcgatcttggtgtcggtcacctgcagatcggtgtcagttccacactctgcaaatttgtacttctgccctatctgaaagaattcatacggcagaatccgcatatcagtatttccatcaactgtcagtcgaccaacgaaacgcttgatctgctggatgaaaataaaattgacatcggtctgattggaaagccggataatctcaaaaacatcaatttttactatctggacaacattgaagacatttttgtagccaatccggactatctctcaaatctgaaaaaaagagggattaccagagattccatccttggcaattccacacttatgcttttggataagcataacatgacgcggcagtatattgacgattatctgcaggacaatcatatttccgtagcggaatccattgatatctcgaacatggatctgttaattgatttcgcaaagatcggtgtcggcgttgcctgtgtcatcaaaagttttgtcacacgggaactccaagagggatctctcgtggaaattccgctcggcatcccgatccacaaacgggaaatcggctttgcatacaaggaaaacttaaagccatccaaatccttacagacctttattgacttttaccgtacttacagaccggaggaaacactatgaaagaacagcttcacaccatcccaatttcagacgccatggcaaatgccggagaatgtccattctgctatattgaacaaaaaaccgaagaacacatgatggatttcgtcctcggacatggtgcctcctacatggaagccgatatccgcgacatgacagaccgggaaggattctgccgcgcacatttcaaaaaaatgtttgattatggaaattcgctcggcaatgcctggattttaaaaacactgatgaaacgtcacgaagaggaaatggatcatgtctggaaaaccttccgtccggacgctgctgcaaaacgcagcagtctgttcggcaaaaaaacagatggttcttccaattccattgtcgagtggatcaaccggcgggaatccacctgtttcatctgtaacagtgtaaaaaatacctttcaggcttacatgaaaaccttcttttccatgtacaaaaaagatgcggatttccgtgcacaggtggaaaataccaaaggattctgcctcgatcactttaaagttctctgcgaaggtgccgacgaacagctttccggtgaagagaaaaaagaattctatgccaccgtccttcctctgatgaaggaaaatttccaccgcgtctatgaagacgttgcatggtttattgaaaaatatgattacaaaaacaaagatgccgactggaaagattccaaagatgccattcagcgcggcatgcagaaattgcgtggcagcgacccgtcccggcctcctcatgtgttaaaaaaataacttttggtttctctttccggcaactataagatagcccacatccatcaaaagcatgcaaagaaacacaagtgccgcatatcctgtaagataccccggatttcccatcctgtctgccagccagacaagcggagatccggcggatggccagttcacaaacatataattcacatcatatcttttatcaaaccagtaaatcggtatcacaaccgcagtcagaaataacaccacctgccagagttttgcaaaatccggtcggatttcatgggatgcaagttttcctgccacatacagtacaattcccatatgaaacaaaaagccttccagtgtaatgaaatgaatgaccggataaaagttccagtttggaaataaaagtgccagcactgttcccgggagacagatggtatacagcacctgccccagccatttccatttcgtcagacaatgaacggcacacaaaattccagccatgctgcacagatgaaacgggagttcatataaaaacgcttcatggatcaccgcaatataaattgctctcacgacaatccacaccacaagggaacatgccgtcagaccatccatccggcgtttttttctttcatccccttttttataaatccatacatatctgacgcatatagcaaaaataaccgaaagccacaacagatgccatggaccgaacaacgcaaatccaatgccatccggaatatgggtttcatatgtaaaaaaataagaaagatatgaaagtttcacatcaaagacctccttttttacagtatctgtgtttttcctttttattatgcaaaacaccctgcgccttttgcgcagggtgcctttcccttagaaatcttctgtctgctgttttctggcagacaggaaacattttatttcattacaatgttcacaagtcttcccggtacataaatctctttgacaatatttccggtcagtttatctgcaatgacttcttttgcctttgcaattacctgatccttcggatcatctttctggataccaagcgttccctttaccttaccattgatctgaacggcaatctccacggaagattccaccgtctttgcctcttcgaactccggccatgtctgctgatatactcttccctcgcatccgataatctgccacatttcttctgtaatatgcggagcaaccggattcagcagaatgatcagtgtctttaactctcccctggtgatagagccttttttataaaaatcattcaaaagtgtcatcatggcagcaatcgccgtattgtacttgaggttttcaaagtcattggaaaccttcttgatggtctgatgcatcttggtctcaagatccttggagtatccctcctcatcagtcataagatcctgcaatttccagacacggtctaagaatctgcggcatccctttactccatcttccgaccaggatgcagccagatcaaatgctccgatgaacatttcatacgtacgcagggtatctgcaccatactcctgcacaatatcgtctggattgactacatttcctctggactttgacatcttctctccgttttcaccgagaatcatgccatgggaagtacgcttctggtatggttccggagtcggaacaacgccctgatcatacagaaatttatgccagaatctggaatacagcagatgcagggtcgtgtgctccataccaccattgtaccagtcaaccggcagccagtatttgagtgcttccggacttgccagtgccttgtcattgtgtggatcggtataacgcaggaaataccaggaagatccagcccactgcggcattgtatcggtctcacgctttgcaggaccaccacagcatggacaagtcgtatttacccagtcggtcattgctgcaagcggagattctccgttgtctgtcggcatataactttctacttccggaagaagcagcggcagctcgctctcatcgatcggcacatacccacatttatcgcagtgaacaatcggaatcggctccccccagtaacgctgacgggagaatacccagtctcttaatttataatttgtctttgcctgaccaattcctttttcttccaggaatttgatcatcttttcctttgcatcttttacttccaggccgtttaagaagtcggagttgatcagcacacccgtcgctacatcggtaaaagcagcctcattgacatccacttcttctccgttctttgcaactacctgaaggatcggaagatgaaatttctttgcaaactcccagtctctctcatcatgtgccggaactgccatgatagcaccggtaccatagctcatcagtacataatcagatacccagatcggaacttcttttccgttgaccggattgattgcagtcagaccgtcaattgccacaccagtcttgtcttttgcaagctccgcccgctcaaaatcagactttctggaagcctgctcgcggtatgcaacgatttcctcccagtttttaatctgatccttgtacttatccagatatggatgctctggtgaaacaaccatataggtaacaccaaacaatgtatcgcagcgtgtggtgtaaatacgcagcttatcttctgtatctttgatctgaaaatcaacctcggcacctgtagaacgtccgatccagtttttctgtgaaactttgacacgttcaatgtagtctacatcattcagtccttcgatcagcttatccgcataatcggtaatctttaacatccattcgctctttaccttgcggacaaccggagcaccacaccgctcacatacaccgtttacaacttcctcgtttgcaagacctaccttacaggaagtacaccagttgatcggcatctcttttttgtatgcaagaccggccttgaataatttcaggaaaatccactgggtccacttataatactttggatctgttgtgttaatctcacgatcccagtcaaaagaatatcccagagaatgtaactgatccttaaaatgctttacattattttcggttacaatttttggatggattttatttttaattgcatagttttctgtcggaagtccaaatgcatcccatcccatcggatataatacattatatccctgcattcttctcttacgggcaacaatatccaatgctgtatatggtctcggatgaccaacgtgaagtccctgtccggatggatatgggaattcaaccaacgcataatatttcggtttggaataatcattggttgcagcaaaagccttttcatcatcccagactttctgccactttttctctaccactttgtggttgtatacttctgccatgtcttcgcctcttcatttttcatattttttcacaatacatttattttacacataccggggtagtttgtcaattgtcatgaggagggacccgcgctctttgcgggaggagcccttatgaccacttccttttccagaggagggacattgccatgaggagggacccgcgctctttgcgggaggagtccttatggctccacatggaaaaatcttgatacctctttgtgggaggagtccttatgacccacttccttacaccccgtcacaaaaacaaaaaccccgatgatatcactcaccggggtttttaaaatcagtttctgattagttgttgatgagcttgtcgctctcgttgttccagctgtacagcttacggatctcagcaccaaccttctctgatggatgctcagaagcaagctttctcatagccttgaaatgaacctgacgtcctgccggagacatatccagtaagaactcttttgcaaatgtaccatcctgaatatcagtaaggatctgcttcatagccttctttgtctcagcagtaacaatctttggtccggtgatgtaatcaccatactcagctgtattagagatagaatatctcattcctgcgaaacctgactggtaaatcaagtctacgatcagtttcatctcatggatacactcgaagtatgcatttctcggatcataaccagcctcgcaaagtgtttcgaaaccagcctgcataagtgcacaaacaccaccacaaagtacggcctgctcaccgaagaggtcagtctctgtctctgtacggaatgttgtctcaagaagtccggctcttgctccgccgattccaagaccatatgcaagtgcaagatcccatgcctttccggtagcatcctgctcaacagcgatcagacaaggagttcccttaccagcctgatactcagaacgtactgtatgtcctggtgccttaggtgcgatcattgtaacatcgacatcctttggtggcttgatgcatccgaaatggatattgaaaccatgtgcgaacattaacatgttacctggctcaaggtttggctcgatatctttcttgtacatatcagcctgtaattcatcgttaatcagaatcatgataatatcagcttttttagcagcttctgctgcaacgtataccttaaatccctgctcttcggctttcttccaggacttgcttccctcataaagaccgataatgacgttgcatccggactcctttaagtttaatgcatgtgcatgtccctggctaccatagccgatgattgcgattgtctttccatccagtaatgaaaggttacaatcttcctgataaaaaattcttgcttctgacatatcattgtcctcctaaatatgtatactcttatataaaaaaatatttttaataagtagccgtaactaatccaaaaaacggacatccgacgatccacgggtaagtcccgtaattccggtacgtgcaagttccagaatttcatatccatccagcagatctaaaaaagcatccagtttatcctgatgtcctaccagctgaattaccatggaatcgtttgtaacatctacgatctttccatgaaaaatctctgtcacattcataatcggctgacgctcgttatcctttgcgcggatctttacaagaatcagctcccgggtaacagaaagtcccggttccagttttttgatatccaacacatcttccaatttcagtaactgtttctcgatctgatccagaataagttcatcgccactggcaacaattgtaattctggtatatttcggatctgcagtcacaccggatgaaaaactgtcaatattatatccgcggcgactgaacaatccggatatccggctcgtcacgcctgggttattttccactaaaagcgataacgcctgtcttctcatatctcgaaaaccttctactttctttgtgttgtttagatcataatactataatctgtgtttgtcaagcactatttttattataactttcggttatattatgaataactcccatctatcagaatgggactttaaaagtgaaacatatgggaataaagaaaggttccgattcccacccccagtaaaatgatcacaataattttcataagaagcgcgatcacactgcagatcacacccgcaagagccatccctctgctgcttccgtactttggcttctgtaatgcgataattccaagaatcaggcctgccgcagcgacaaagaatgtcagccattttcctccggcacagcatgccagcagaatggcaacaatcccaaggatcatggaggcaattccaagcccgtttgcaccttcatccatattctgcggtgttccaccataagtatacggattatccgggtttacaggtgttccacaatatccgcacataaccgaatcatcgggaatctctcttccacattttctgcaatacataatttctcctttgtttaatacaatgtcttaatggctccattataatactgaaggatttttaaagcatccgtcagatccacttttccgtcacggtttacatctgccgcagtcttttccgcgtttgtaaatgttttcgtgttgttataatactgaatgacatataacacatccaccagattaattttcccgtcaccactcacatctccaagcgtatgtacctgatccgtgatcgtcacacttgaggtcgccgaattataggaaaagatatctccctgctggtcttctacagattctatggcaaccgtaacatctgtactgattccattattggagtatgctgtcatcccattcgcaagctgaaaatcaatgtacatcagatttcctgaagtattgacatctgctgttgcggtatattccgttgtcagatatcctccgtaggaagacatattataatcactctgtgtaagtgtcgactgcacttccggtgccagtgttatggactgaaaagcaagaatatttttattataagtaatcctaagcttaattttattaaatccgtcatttcgggaaaaatacaccggtacggaaatccgtccgtttccctttacaattccaagagatagcgtaacggcctttgcctgggaattggtcagtgtgagtttctgcgttttcaattccacatccgttccatttgtccgaagataggacgggctaaaggtaatatccgtcttaatcaccggttttgccgatgtaaatttcagtgtggcaatggatgatcctgtcactttcacagggtctgcaatctgcccggttgtatttcctgccgcatcctttttataataatccacggacagaaaatgtgtatacccattataggaagccttccactctccgttattgtctgtctttccggatgtggtgcccccgccaacaactaccgtaaccgaagtaaatactgaattgtcataagtcaggtatcctccgaatccggaagtctccgcattgacagaaaatgtcacatcaaatgactgtcccgcatttaaattgatggagtcactggcagtcttcatttccagcgaaccggcagcagccgttgttgttgctgcaaatacgtcaggcggcttcacgccggctcccacaatgaccatacatgccagcatgattccggctattaatttctttgcttttttcataagaattcccccacttgtatgtgttttgatcctctgtaactcattctatgtcttatcctaccattctctgtagcaaaaggcaagaagtaacaaagccggaaatttttctcttctgcggtaattttaagaaacaacaatttttaacacgaccggaaattcagaataaaaaccggaggtcttcacatgcagaccttctgcgtccgttttccattccggggatttttcatatccaagaacttctacctgtctgataatcccatggaattccgggagattctggtcactgctttctgccagagactgaacgcaaaagtttccatcctgcgggcactttaacgcaatggcataaatatttccatgattcactgtaaaacggtaatcctgcggcgtatagaccatctctttctgatctgagaactgtccctcctgcatctttgtcggaccttcggacgattttctccatacctttgctccatggatggcttcccggttcaccgccatccagtccgccagatcccggagaatctttttatctccttccggaagcgtgccatccgccttcggtccgacatttaataaaagatttccgtttttacttaccacatccaccagcgtacagatgatttcttgacttgttttatagatcagtgtatccgtatagcaccaggaatttcttgcaattgcggtatctgtctgccacggatacggttttgcctccgcaaagccgccacgttccatttctacaattccactgccaaacgccatcgcatcatgcttgtaacagatggcaacattcgtcccccattccgctccgcaattataataaaacgcggcaagtttctttaaatagggcttaaatgcctcatgctggacccaccagtcaaaatacaacaggcgcggacggtaattaaggataagttctgccgtccgtgccagccagtcatcgagaaactcttctgtcggatacggtctggaatacaggtcctccggatctgcctccggcatggatggccagtaaaaatccccttttttcagtggttcatggatatcactgtcaaacgtttttccatttccgaggaaaaaccagtgttccgcacggtgggaagatgtacagaaatgaattccccgcttttttgcttcctctttcagttccccgagaacatcccgtttcggtcccatgtcgaccgcgttccaatcggaaagatcactccggtacatctgaaatccatcatgatgttccgctaccggaaacacataaccggctcctgccgcctgaaacagttccatccactccgccgggcaaaaatgttcagcccgaaacatcggaataaaatccttatacccgaagttcttctgcaatccataagtttttctgtgatgctcatatgccggcattccttctttgtacatgttgcgcggataccactcattggaatttgccggaacactgtaaacaccccagtgtataaaaataccgagtttttctttcgccagccactgcggcatctgcgcttcacacagcgatgcccatgaagcctcataaggtcccctagcaatcttttcttctaccttctgtaaaatttccttttcccgttgtgcaattctcatccatcattctccttaaccgttcgattgccggataattattgggattgatctgctctttcgatgggagttcatccatacggaaaaaacaaagtttttctacttcctcctgctggcagatgatctgtccggaaaatttccggcataaaaagatctcttctgcggcataaatttcatccccgtttggatagacataatgtacttcttctccggagacattcataaagtgttcgaggtttccgcagatcagtcctgtttcctcctgtacttcccgtctggcacagtcttcaaagctgtccccgagttccatagaacccccgggatatccccataacccgttgtctgcacgtttctgcagaagcaactcccttttttcattcaaaagcagcactcctgcacaggtcataatcaacggccgatgacctacctgttttctcaattccaatatatatcccatatgttttgttctctctttcttttttctgtctccatcatagcatgggaaaagaaaaaagaaaaccgcgcatcttttcagatgcacggcatttgctgcttatatcgtaatatcctgtgtcaactggatatcctgcagggagcttccgacataaatgcggtaatccccatgttttaatctccatgttccggcagcttcatcataatgcatgaaatcttccatcgtgattttcaaaagcacggtcttggtttccctcggacgaagacagattttttcaaatgccttcagttccttcaccgggttttccggagaaaccgtcttctctccaagatacaactgaaccgtctcttttccctccagtgctcctacattgcgcacctgaagctgtacatcaaatccattggcacgcgctttggacggaatttcctcaatttttaaattatcataggtaaagtctgtataagacaatccatgtccgaaacaaaactgtaccggaatccggttcttttcgtaataacggtatcccacgaagatgccttctgcataggtctgtgtcaaatgtgcattcatatgtttcttctcttcgtctgttagaggtcttcccgggaaatacgcttctttccggaaacattccggaatctcttccggaagcgtttctgcaagttttccggaaggatttactgcaccaaacaatacctctgcaagcgcagtgcctccttccataccgctgtaactcatccaaacaattgcctttgccctgtccgcccatggtttcatggaaaccggacttccggcaagcattacaattgtcatatccggtcgaacctcaagaagctctgtaatcagccggtcctgtccgtatggcagggttaaatccgcacggtcctgtccttccagatcctgatcatgatttaaaccacccacataaatgacatgcttatattcttttgccagttccacagcttctttccgcagacgtgcactgtcctcggtttcctttgctgtctcagccgccgctttgcttgcatcaaggctgtcttcctgccagttatgatcgctttccttttttgccggaatatcatatcctctggcataacggacttcgcagtttccaccgagaaacttgctgattccaagcagtggtgtaatctcatacaaagctttaatctccgcacttccgccacccatagcctgtgaaatcactgcattctgcccaatgacaagaactttatcgattgcaggatcaagcggaagtttccggtcttcattttttaacagtgtgatcgattctcttgctacttttaaaacttcaaaacggtgttttgccgtattataacttcccgctttccggttcttgttcttctgaaccagaattttcttttttccatcagaatccggtacttctgtcagttcaatcatatgcagacgtaccatcatccgcagaatattgcgcactttttcgtccacacaggcctcatctatatgcccttttcggatttcgctgatcagcggattcgcaagaaaatagtcatcaaaatcactggttaccgacatttcgatatcaagcggtccctctgcggtcccctttgttgtatgtacggctccccagtcagagataatggttccgtcaaatccccattctttgcgcagtacggttcccataatatctttgttttcacagacatgtgttccgcggatcagattataagagcccatgatcgactttgcacccgctttttgtacaaccgcctgaaatgccgggaaataaatttcacgcattgtacgctcatccgcttccacatttacccagagccgttcggtttcctgattgttcattgcaaaatgctttacacatgctgccacatcagacgtctcgattccacgaactatcggaacggcaagttcactggtcagtcttggatcttcactgatatattcaaaatttcttccgcatgcaggtgttcttttgatattaatacccggagcaagaatcacatctttgcctcttccgcgtgcttcttctcccaacacttttcctgcattgcgtgcaagtttgcggttccatgtcatcgcaatcgcactgttgctcggacaatatgtcacataatcatctggtgttccgaccggcatccactgatcattgacaaactcgctgcgcacacccatcggtccatcggacatctttaaagggggaatatgaattctttccacccccgcggtgcgaaacagacccgcaccgtggatcatgccggttttctcttccagtgtcatttccttgatcaaaagacagatccggttttccaatactttatccatcaatttttcctcttacctgattttactgtatacactctatgtggctctcacagtcacgaagaatggtgtttttattttctttggatgcctttgcgcccttcacatctaaaatgccggtattaaccagttctacggtaaacggctttttgctgtcgcagtcgatcacaagcttatcctctatgcgttttaccacaatggaagccactttattctgatccatatcgtagatttcagcagctgcctcatcctgtacatcatatacacggaatgtcacctgatcggcataatcatactctggtccctcttcgctgtttccaagcggaagtaccgtattcggacgtaccatcagcggaatctccgtataagcatatgtgcgggtataccagtctccgccttcctgctgcctgccggtgaagaaatcggtccatatgccgttctcctttggcagatagtattctccaattccctcatcgttaaagattggagcaactagtaagctgtcgccgagcatatactgcttatccagataattgcacattttatcatttgtgtaagaaagaaccatcgcacgcatgcttggaattccctcgttatgtgctgtcagcgcggtcttccacaggtatggcatcagacgtgctttcaggcgtacaaagctgcgcagcacatccacggcctcatcgtcataagcccacggcacacggtatgatgtacttccatgcagacggctgtgagaagaaagcagaccaaacgcacaccatctcttatagacatccgcggtagaagtgttttcaaatccgccgatatcatggctccagaacccaaatccggaaagctgtaaggataatccgccacgcagactttcttccatggattcataatcagaccagcagtctccgccccagtgtaccgggaatttctgtccacctgcggtagcagatctcgcaaacagtactgcctcatcttttcctttctttttctcaagaacttcaaatacagcttcattatataaataggtataataattgtgcattttttccggatttttcttgtcatagtaaacgcaatcggttggaattctctcaccaaaatctgtcttgaaacaatccacacccatatcaaccaatgcttcgagtttcttctgataccatttctttgcctccgggttggtaaagtcgacgattgccatgcccggctgccacatgtcccactgccatacagaaccgtccggacgcttcaggaaatatccgccttccatgccctcgtcaaacatcacggattcctgtgcaatatacggattaatccatacacagatctttaatccctttgctttcatacgggaaagcatcccctccgggtccgggaatacacgctcatcccacaggaaatcggtccagtggaaatctttcatccagaagcagtcaaaatggaatactttaagcggaattccacgatcgagcataccatcgataaagctcataactgttttttcatcatagtttgtcgtaaaggatgtggaaagccagaggccaaatgtccaggccggaggaagtgccggttttccggtcagatccgtatagcggcgcagaacatccttcagatccggtccgttaaagaagaaataatccagactctctcccggcacagaaaattctacttttgtgaccgcttccgttgccacttcaaatgatactttctcggtatggttgacaaacacaccatatcccttgtttgaaatataaaacggaatatttttataagactgatcggtggaggtaccgccatcttcattccagatatctatggactgaccgtttctggtaaatgcggcaaagcgctcaccaagaccgtagatcagctctcccacacctaaagaaagctgctgtctcatataggcatccttatctgcgctctttacataagcatcacccttccagtccgtcttcatataggcaagatcacgccatgcactggtactgagcttcttatccccgttatagtaagtcatggaccagttctctttggtaataaccagttttgcatttccgctttttacaacaatcttctcatcatcttcggtggcatcaattgctgtctgtttgggaagatttaatgcaaactgtggtccatcctgaattgcgcccttataatgatacgtctttacacggattacttccggcatcggagtggtaatttcaaccgtaagattgattccgcccaatgtatctcctctgtgattaatcttatgtgtcggtgcacagagcactactttatctttttcaatttttgtaaaataaacttctgccggtgaaaagcaggcgcagccttctttctgcagccagcatccattactgaatttcatatcttattttcctctctttcccttcgccatacgaatgttttattttcccttatccacactatacaaaatttatccgtgctttcctactagaaattttagacgtaatttactataatatttatagaatttgccagacggtattatcccttaattttataacaaaggatattttatgaaactacatattaataaaatacatgatacacattctgtcagaagtcagctgcttcgtatttttctgctggcaggcatgtttccgcttctggtaatcggcatcttttccattgccagcgtgcgaaaacagatgcttgcccgctatgaatctctggagaaggcagatggcctgcgtgttgcctcctccttaaacgacatcacaactaccgtatattcatcttccgataccctgcttaacagtaatcagtgtctgagtctgtttgcggcagaatcactggattccggtatcgaggaacagcttacggctctggagcgggcactccagacttattttgagaatacagcagccgttgcccgcattcagatttataccaacaatccaaaccttcaaaattccgagcatattcattatcagcagaattttgtcctggacgaatggcgcaaaaccctgggaaataactggagtacatgggcttccctgcagcgatacacggcaatcgtccggcagccttaccgtgaactgacactgatccggcggatcggtgttgcctccagtaaatatcaggcatttctggttgtcggtctggaccgcaataccattaaaaatcatctggagcagtccagcaatgaaacaaccatcagtctggacggaacccagatcatctatgccacagactctgttctgatcggcaaagacatggagtttcccgatgatttttccggctatatttaccgctacaccggtccgaaagaaatcggaaaccagatgcgtctggtcaactatgtaactctgcagtcctacaaatccaacaatttgttttatgtgcggaccgtggacccggatgccttaaaaacaatcaatcataccgttgccgtatttgtcctgattctggtacttgccctgcttgtaccattgattctgatgatctgtttttcggactatttcagcacaaggattacaaccctgaaatcagcaatgcaccgtgccagcctcggcgattacaatatcatcgaacaattccgcggtgatgatgagttaagcgatacctttaaagacctcaaactgaccgtggatgcgattcacgataaggaagcgcagttttatgaagcacggatccgggaacagcaactggtcaaccggcagcagcaaatggaatttgaaatgcttgccagtcagatcaatccgcatttcttgtataacactctggaaacgatccggatgcaggcactctcctgtggcaaccggaatgtagcaacttccattaaactgcttggaaaatccatgcgttacgtgctcgataataccggcacaagtttcaccacactgaccaaagagctcgaatatatcaaaacgtatctctccattcagcagctccgctttggggaccgcgtaaattacacccttcaggtggacgaagatctcgacaccaacagttgcaagattcttccgctgctcctgcaacctgtggtagaaaatgcaattcttcacggacttgagagcaaaacggaagacggtatgatcaccatccagattgcttctgcggacgcaaccctgctgatcacgatcaaagataacggacagggaatgacaaacgaagaactcgacgcactgcgggatcgaatcagaaaccacccttcctccgatacccacagcatcggtctttacaacatcaatcagagaatttccctgttctacggggaaggatattatatggagattgacagcgcaatcggagccggtacgaccgtccggctgaaaataccaaaaacaatttaggaaacaggatgaaaaacatggcaaacaaaattatcaacgtacttattgtagatgatgaacaaattgtaagagagggactccgctatatcattgactggaacaccctgggattttgtatctgcggggaagccgccaacggagaagatgccctggaaatgatccgccagtaccgcccgggactggttcttctcgatatccggatgtccggaatgcttggcacggaactgatggaaaaagcgcgcagtgaaggattttccggtgcatttattatcttaagcggttactcggattttaagtacgcacagacggcactgcaatttggtgcctcctactatctgaccaaaccgattgatgaagatgagctggaaaaagcagtacaggacgtccacgaaaaaattgaatttcagctaaacagcgagacatcccgcaaccagtacctgaaaaaagcaaaaaccaccgtactatacgatctgctgaccggaaatgattttaacccgtccattgattatcaggaattagggctctcctatccgatctatcaggtgctgatttacgaaagctatatgccatattttcgttcctacagtttcagtgatctgctgcgtgtcaccaacaaagacaacaattcctttgagcatgtcaatatcgacaatcatgacattatattactcaaaggcaattttgcactggaacggttaaatgcctgtctgcaccactatgacaagggaacgcagaaaggatctccgctggatacgatctttctaatctacggaccgacggtttcttccctttcacagattcacgaatcttacgagctgtgccagcggctgttgtcccggcgtttcttctgcggagaaaaccagcatgttctctcctatgaggaactgccggcagaaaattccgcctccgcaagtctggacgcagaaaaaacaagacattacagcgcgttacttaccgattacattaaaacctgtaatcagcgccggatttccgaagttctcgaagatctgcgacagtttctttttaatagtaactgtgatgtatcgagtatcaaatattttctggcagatatttttctggagatcaaacaggcgatcacacacacgtacagcaacaccagtatcccgtttgtacataatgcggcgatcatagaactcattgaaaataaatactatctgtacgagattctattgtattttaacgaacagttcgatatgatcatgcgcgcgatcggaagcaattcctcggcaagtgtgttcgatgatattttaaattacatcaatcacaattatgccagccagctgaaattagagactctggccccactgtttggttacaacagttcctacctcggaaaactgtttacccagaaaatgggtgttcgtttcaatacctatctggatcaggtacgcattgaaaaagcaaccgagctgcttgatcagacagatatgaagatttatgaaattgcggcaagtgtcggatataaaaatgttgattattttcaccagaaatttaaagcgagcaaaaatatcagccctgcggaataccgtaaaaatcaggatcattgattataagcaaaagaaagccgggtgcatcacgcacccggcttttgttaagggttttatctgattttatccaattacttagattcgcttaatacatcattgatgcactttactttatcttcataatctttcttatctacttcaaatacctgatcgtatccaagaccctttacggtatcctgcatatcttttaagatcttgttgaactcagcttcattctttgcaaataccatctgccatgaatctgcaacgattgtctgcttgcactgctctttgatggtactgatatcggtagagtactccggtgtggaatagtttgttcctggaagaactaacagattaccggttttctcaaagtgttcgatctctgtggtatctccatcattatgtgctgaccagtcttcttttaacttggtagaagtcttctcaagataatcatcccatctctgatagttgtagcagataccggtatccggatctgtatcaacgataccatttgccttaaagttcaatgcagatacaccatctttccatgttccgctgccccattcatccggcactttcaggctctcgtcaatatcaacaaatgcctttacaccgaaatctgtaagtacaggcttaccatctttcatttcccatgtcaggccttccggtccacagttaccaccactctgtgcagaagaagcttcaattccttccggagagtataaccagttgataaaatcaaccattctctgtgggtcttttgtctggctgccgaccatgataccaacactcatcttaccatccggcatagaaccgtaagacaggcacttcatatccttaattgtcgcagaggcaaatcccttaccttccgaagtattctctgttgtgttgtatacaccggcaccaagccatggccagaagctgtataatacatcaccattacggaactttgtctgtaacgtatcgaaattctgtgtggtagactccggatcaataagtcctttctgatttgcttcaaacaggaacttcaatgcacgtacatacatgctatcgctgtcaattacactctggatttcagatccgtctactttgccgagtgcaaatccaaggttctcatatccgtacagagcacagaaagcacctgcattctgcatggtatctccatcccagtctttgaagagagaaagcgcatagacatcttttccgtctttgctggttccctttgccttttcctgcatctgttccagaaccggaatcatatcttccagtgtatccatttccggatatccaacttctccatacacatcccagcgaagagatggtgcattggttggctcagatgcctcacaaggctcagttgccggctgattggaaatttcactcggtactgcccatactccatccgttccggaaagtttacttgcggtattgattgcatccatacgatcctgtaaatatttctcatccttaatataatcactcatatcaaggacaagtcctgcggtcaccatatctttcaaacgactggaatccagatttgtgataattaagtcaccaagattaccgtttgcagaacgtgtctgatataaagtatctccaccacctgccacgtttggtgcaataatgttcaatttgatattgaacttatctttgatcagttttgcaaaccatccggtctgctcaccctggaagtttgcctgactgtcgaacacatcaatcgtcagctccttggcatattttccattggatgacttgcccccctgtgtggaatcactgtctgagctttttccgcagcctgctacggttccggcgagcatcgttgcagcgagtgccagtgcaagcgcacgctgtacattctttttcttcattgtaaatcctcctctataatattttacatgaatgtatgtaaaagaaacaagtgtttcttttagcctttcactgatccgatcataatacctttgacaaaggatttctggaaaatcggatatacgaacagaatcggcagtacaacgataacggaaatcgtcatacggatggatgtcggtgtctgctgggttgccaggttcgcaacggcagatacatttccaccggactgctgtaccatggttgccagtgaacttgcctgattcaggtaagtataaagtaaatactgtaaggaatataacttctggtctgtaatataaatcaacgtatcctggaaggagttccactgtcctactgcggaccagatggcgatggttgccataatcggtttacaggttggaaggatgacttttgcgaatacggtcatggttccggctccatcgatctctgccgcctcctgcaatgcaggcggaatggattctacataagtctttgccataatgatgttgaacggctgtacaattgccgggatgatgtatacccagaaactgttggtcagatgtaaggtcttcatggtcatgtacattgggatcagacctgcgttaaagtacatggtaattaccataaaacgataccacagttttctgtgccacatccgctgctgggtaaacatgaatcccagataaacggaagcaagtaccgtacagattgtaccgatcacagttcttccaagggataccattgctgcggttccaagaccgttcagctggaatacttttacatagttctcaagctgaaaaccatgcggcagaaaatttactttaccacttgcactcagatcgtttgcactgatcgagttgatgatcagatagtaaaaaggataagcacaaatgatagcaaagatagcaaaaatcagaatattgattacctgaaatgtgcggtctcctttacttgttttaatcttcattgctttttcctcctattaaatcatgctctcgccacgtgtcttcttcgatacgaagtttacaattgcaagaagtgttacgctgacgatactctttaagataccaattgccgttgcaagggataagcttcgtccggtcataccaatgttgtatacatacagatcaagtacctgaattgttgatttgttaaatgcattctggaacacaaagtactgatccataccattattcaggaagtttgctaccgaaagcattaacattacgaagtatgtaggcataatggatggaatcgtgatgtttttgataatctggaaacgtccggctccgtccacctttgccgcatcatacatttcctgatcgattcctgcgattgctgccagatacataattgcgccccatccaaggcctttccatgtactccagagaatcatctgcaaccatacatgcctgccactgtcgagaatctttaacggttctgagattacgccaaggttctgcatcactgtgttgaacatacctgtggtagaaaacagacagaaagcaatggagtaaaccagtgtccagctgatgaagtttggcagtgtagtcagtgtctgtaccagattcttaaaccatttgcatttgatctcgtttaagaatacggcaaacagtaccgggagaaatgaagttgcaataccgagtaaactcattgcaaatgtgtttttcattacctgaatcagctgcattacctgcgtcttgttactaaacagtgtcttaaaccatttcaatcctacgaactgacactgggaaagtttcagcggtgctttgtaatcatagagtgcgtagatccagccatgcagcggaaagtacgaaaacaaaaagcacaaaatgagaaatgggagaatcataaggaataacttcattccctgactctttttctttttggtcgtcataatagttcctccttctcgtaaccgttttatggttcaccgatgttttatgttgttattctatcatcaggaaatatttcctcctaccggaagaattcaaggagagttcccagaatttttagatgttcatagattttttacgatatatcagatttttatggtaatttttctggaatttttcatgtatttgcccgggcacaattcaaaatatgaaaaaagagatgctcttaccgcatctcccttcccatatttaccggatttttttataaagtttcgttgaaaaaacgaagcatatgttcgctccatgctttggccgaagtagcatatcctaacccgatgccgtgatctcccgtcggaaaagtctcacacagatgcttcactcctgctttcgtaagtgctgcgtccaaccggatcgtattgctggctggaacacagccgtcatcgagattcgcataagcgtatgttggcggatagccggtcagatcatgaagttctacagacagttttttctgaagatccgggtttccgcctgtattacagcgacagcttccctcatgatattccgaggtaaaactgatcaccggatacaacagtcctaccccgtccggccgtgcagaaatccttccatatagtttttccagctccggatgcacacaaaaaatttctgttttcagttcttcatgcagcatggccgtgcttgcgcacaaatgcccgcctgcagaagctcccaccacaagaatacggttttcatcaatgccatactgccgtgcatgtgcacgtacatgcataatggccagtgccaaatccatctggcactgcggataggtattgggctggatgcgatagcttaaaataaatgctttatagcctccgtcacgctccatgcgctgtgcaagctgcacaccttccgaataatatgaaagcatctcatatccgcctcccggacagaaaataactgccggacgcttcttttcctgtcttcgttctttagaaaccgcgacagacggatacggtggaacggatgcacagtcatcaaaatgcataaatgcctgcgaatccacatccggatttcccgtaaacagccatacaccctcttcgtcattttgatcctcttttggaatccacccctctttttgcgtatgccagagaggtacaaacagaaatttttgtttctctgcggtctccatcagcatattggcacagtttaccagtggctgggaccagaatgcttcgccccactccatgtgcaccctgtcatggatctgttccatcgtttcttcctcatgcccctgcagcagtatgctccaacaggtcggaaacagatctcccaatgccgtatccaccggttttgttgtttttatttctttccatgtcgatttcattgaaaacatatagtttcactccctgccaaaaaccatatcataaatcacatccgtaatttcagaattgtccggcaaaatgcctgttataaaaagtcacgcaacatacgttttctgctcggtgcaccaagtttacgcagtgcctttgcctcaatctgacggatacgctctcttgtcacatgaaacatctgtcccacttcttccagcgtgtgcggctgatttccgtcaagaccgaaccgcagtgtgatcacttcctgctcacgatccgtcaggtctttcatggcaagtgaaatctgcttattacgcatctccgcaatcgcattctcctccggggataacgcattggaatcctgcacaaaatcacccagatgggaatcgtcctcatcccctaccggagcctccatggaaaccggatcctgactaaaactcatgatctccgttacacgatcttcatcttcgccaagcatctccgcaatttccttattggaaggttctcttcccagctcctgtgtcagggtacggcgtgcacggacaaccttattgattgtctccaccatatgtaccggaacacggatcgtctttgcctgatctgcaattgcacgggtaattgcctgacggatccaccatgtcgcatatgtggaaaacttaaatcctttttcgtactcaaacttatcgactgctttcatcagaccgatattcccctcctgaatcagatccagaagcggcaatcccctgccgacatacttcttggcaatacttactaccagtctgagattggcttcaatcagttccttcttggcttccggatcaccctcactgatccgcttggcaatcttttgctcttcttccatggtaagcagacgcacctgtccgatcgtctttaaatactgacgtaccggatccgtgatatccgccccctccataaccgagagatcttcctcgatattttcctcggaatcttcctcaatatcatcatcaatatccaaaagaatcttactttcttccagttcttcgtcatccagttctttttcctttgcagacaaagaatccgtctgctccatgtcattttttgagcgaaggacttcgatcttgttatcttctaaaacttttaaaatgttgtcaaactgctcagaggaaatctctacccctgaaaatgtatccaggattttgctgtatgcgatcttatcctgattctttttgccctgttcgatcaggcctgctaccatttgaataatagaacgtttatcttctgtcacgaaaaatactccttatcaataaattcccctattttattttatatcttcttttaggttctaaaacattttaccacaattcaaaaataattccacaccttttttcgtatttatgttcattatttgatacacctttgcattttccagaaccacttcgtccatctaatcctcaaatttcttatcttcatcataccagaagataatgcgacgctgataaaactccggcaaaggtgcagcaaatctgcggttcaagtcttgtattattttttctgtatccatgctgctcctcctaccttataactgtccaattagcttttcgctttgttccgctctgtaccaatatacctttttcctgtaaagaaacaaacattcgagaaaccgttcttttcgacacgcctatctcttctgcataatatgcctgtgttgcagatagatttttctctataatctgcaacaatttttctatctgtgcctgttccttattaagtggcacttcaacgccattagtgccatttccagcattattaacgccataatcaacgccattaacgccatctttagtgtcattggcgttaatcatggcgttatttgtatcaacctgacctcgataaatattgatacgcaaatcaacttcgctaccaataaactccggttcccgcagtccagcagcttttactttatcaataattctcggaataccgcttccccaatgctcaatcaggttcatatatgcaaacacatgggcgacggcttcatttctgattttggaatagccttctttcatacgctccatcgtttgccccattggcattttccctggagaagtgatttccaatcggttgtcatataccgcaacctgtatcgtaccataatccagataacgatatttgatggtattgaatcaaaaatattatgtctcactttattctcttctttacaggcactttctcggcatattcctgttccagttcctccgccagatacgcatcgctcatgcagtgcatatcggaaacaccatcacggatcagctgataaaccagtgaatgataaaagaaatccaaagccgcatccagtgaaagtccctgctgtttagcaaagcattcaataacacggctgtattttttctgaagcaaaatcggattcgctgtcatagtgtttcactcccttcaaaacgcagcagagacagtgctttctctgtgcggaaacatatttgcaggttcggcttttcataacgcaggcggctgatagcttccgttttatcaatcagtccgtcaaagaacagctccaccgtattgaacaccttatcattggcaacaccgcctacaacaaggtcataatccatcaaatcttttccactgcggcagttcagaataaaatccagccattcttcggaataagaatcgaatttcagcgttttcagttcagcttcccggctttcaccgtattcatacctggagataataccatttttcccacggtatttgaacttgccgcaccacttcgctgcctgttcatacaacggtgtgacataaaagccacgcccgaagtctacgttagggcgggaatgaaccaaatccggcttagcaatctctaagaaagaaccatgatagagaatcatacttccacgcccctttctttcatcacatcaagaagatcattaacgatatattcccggctctgggtatgcagcacttcatattccggcacgatataaccgttcagaatgttgcttttttcagtaaatgcctgatacacacgctctgcatccacacccagctttgccgctacattttcaatgcaaaacacggcaaactccaactctctggaatttttgattttttcatccgccatcacgtgtcaacctttcctatatttttaataattcatagacttttttaaaaattcaacctttgttctatttccttatctgcacaataaaatcaaaataatcttttccaattttagtttcgacatctggataacctgatgtatcaactatccaatgattttatgggctttccttatattgtatttaatttaaaattatttattgttatttacagttttttgcttttattttgctaacgcggtcaaattgcggtcaaacttctaattcatttaatttcttcatgtactctgccttctctttataccctctgatttcatttgcaccaagttgtaatgctctgcgaatatactcttcatcattttcatcagacgcatgtttacaccttctagtatgattctgctgcagttttgatgaacatggatacaattcttttactattacgatcaactacagtataccatcaaaacaagacgatttctattatatctacattttccaccaaatgattcacaataaaattgtacttatcaatagaaaccaatcgcggaatactgccaacttctcgagacagttttgtcctgtttaaaatatctacataagatacgataaaatacagaccatggaacaattgtgttgcagggtggctgacctctattttattttacatagaatggggtggtgctgatgaacaagagatttgattttaaagacctcatgacctttggtctgttcattcttgcattactgacattcgtatttacgtttatcagataatgttttagaacatagaaaaaccaccccaaaaactttgactgagtactagggtggattttctaactagatttacgaggtcaaccacttgtggacagttgttcctcttttatttacattaactataacacgacacgttccaaaaaacagtagcattatttatatcatatgatagccctaaaaccacagaaggcaagctcataatcaaacaaaattatcctaaccgttacaataaaacgcttaagggtgtctgtattccagacaccctctttttatatctaaatccggcgggaaatttgcgtcctaccgtttgtgtcctacgtggcaaaatttaaggctaccgtggaacattgtaaaccacgatagcccttgattttactgtgttttttagaacttaccagcctttgcagcttcctctacggatactgcaacagcaacagtagcaccaaccattgggttattacccattccgatcagacccatcatctcaacgtgagccggtacggaagaagatccagcgaactgtgcatcagagtgcatacgtcccatagtatctgtcataccataagaagcaggacctgctgccatgttatctgggtgaagtgtacgtcctgtaccaccgccggatgctacggagaagtacttcttaccctgctcgatacattccttcttgtatgtacctgcaaccggatgctggaaacgtgttgggtttgtagagttaccagtgatggaaacacctacgttctcatgatgcatgattgcaacaccttcctgaacatcatcagcaccgtaacattttacagttgcgcgaagtccgttagagtatgctttctcatatacgatgttaagctttgcagccttgtaatcatactttgtctctacgaatgtaaatccgttgatacgggaaatgatctgtgctgcgtcttttccaagaccgtttaagataacacgaagaggtttctgacgaaccttgtttgccttctcagcgataccgattgcaccctcagcagctgcaaatgactcatgtccagctaagaaacagaagcactctgtctcctcctcaaggagcatcttaccaaggttaccatgtcctaaacctactttacgatgatctgcaacagatccaggaatacagaatgcctgaagtccttcaccgattgctgcggcagcatcagcagctctcttgcatcccttcttgattgcgattgcagcacctacagtgtaagcccagcaagcgttctcgaaacaaattggctgaatcttcttaacctgatcgtaaacgttcagtccagcgtcctttgtaatcttttcagcttcttcgatagagctgatcccatagctgtttaaaacagcgttaatctggtcaattcttctttcatatccttcaaataatgatgccattatatcgttctcctttccaattattcctgacgtggatcgataatcttaactgcatcgtccacacggccatactgacccttggctttctcccaagctgtgttaggatcatcacccttcttaatgaagtcagtcatctttccaagagaaacgaactggtaaccaattacctcgttattctcgtcaagagcgatacctgtaacatatccttcagccatctcaaggtaacgaacacccttctcttttgttgcatacatagtaccaacctgagaacgaagtccctttcctaaatcttccagaccagcacctacagcaagtccgtcatcagagaatgcagactgtgtacgtccatatacgatctgtaagaaaagctctctcatagctgtgttgatagcatcacaaactaagtctgtatttaaagcttccagaattgtcttaccctgtaaaacttctgcagccatagcagctgaatgagtcataccagagcaaccgattgtctcaactaatgcttcctcaatgataccgttctttacgttaagagaaagcttgcaggcaccctgctgtggtgcacaccagccgacaccgtgtgtaaatcctgaaatgtcctcaattttcttggaatgaacccactttccctcttccgggataggagctggctcatgctttgcgccctttgctacaggacacatgttttcaacttcctttgtgtaaatcatcttaagactcctttcgcatgttaattgtagataaactcgttatcattcgacataccgctaatatttttgcatattttttccctaaagtctagtgcaaattcgcacttttttagatacaactactatttttctttttttgccacaatatggtctgcatccttgtagatatggtttgccggaatcactccgcggacagaagaaagcggatagacattacaattcgggcagataaccgtacccggatttaaaacggagttgcatcctacctctacgtgatccccgagcatagctccaaatttcttaagtcctgtttcaatttcttcaccggaatctctgttgtcctttacaaccacaagtgttttatccgattttacattggaggtaatcgaaccggctcccatatgggacttgtaaccgagaatggaatccccgacgtaattgtaatgtggtacctgtaccgtgttaaaaatgatatcatttttgatctccgtggaatttccgacaaccgatccttttccaatgatcgcactcccgcgaataaatgcacagtgacggatctcggcatcttcatcaataatcagcggtccgttcaggcatgcagtaggcgcaacggttgcactctttgccacccatatattttccccacgtttctcataaatttccggatcaagttccggcccaagttttttgataaaatcgctgatgccttttaatgcttcccacggatacgtaaactgtgaaaggtactctcctgcaatagactgtgacaaatcatacatgtttttgatttttgcgttttccattttttaatctccttacattttaattttcatgattactgatcgtttttctttcggactcttccgtttccttcaaagccgttgtttcctctgcggctgctgcttcctccggcggtgcctcccccggattatcaaaatcaaacgaaatctgatcattttcatatttcaggcaggtgtcaaatgtattgcctgcctttgaggtaaatccggcaatcttctgcttcgtctttccggtcgtcagcagttctttcatcacttcttcggaaagttccaccttagcaacggtatgccagatcttaaatccgcacgcacattcatacctccactgcgtcttcatcagcattttgccgcatttcgggcacggcacggttgtctcttccggtctcggtttctccggaaaatcaaatgcgatctccccttcttccgtcagtttcagcggcgcatcaaatttcataccggtctttgccacaaatcccgaaattacctctgtcttctttttcgtcagaagctctttcacctgcgcttctttcagccggacacttgcgatacttccaatcataaagctgcagctttccttatcatcttttttatgattggcacacataaatccaaacggtgccactacaatatccccaccacacttcgggcacttcacatctttgactttctttggctctacattgtcaaaatcaaatttcagcccggttactttcccgttttcatcttttgcgagagctacgcgcgcatcaaatttcttccctgtttttgacttaaacccacgcatggtttccgtaatgccatcgtttaaaagctgccggacctgtgcttccgtaaaagatttctctgccatcttcccaatggaaaaccggcagctgttttcatcgcccggcttatagttagcacatccataaccaaaagaggttgcaatgatctcacccccacagagcggacactttacatcgcggatcactttctgttccacgctgtcaaaatcaaatacgatattcgtctttccctcttcggatttctccagtttcaggcaggcgtcaaattttttaccggttttcgatttaaaaccgcgcagggtatctgtgtgaccatccgtcaggagctgctttaccgcagtaaccggcagggtttttccggcgatcgttccaatggaaaaccggcagctgttctcatcgtccggtgaaaagtttacacatccatagccgaaagatgtctttttaatctgtccgccacattccgggcactttacctccggaatgatttccggctctacgtctgaaaaatcaaatgcaatattaacttttccgttttcatctttatctaccttaagttttgcatcaaaccgtttgcctgccttggatttaaacccgcgaatggtctgggtatgcccctgttcgataagttcttttacctgttcctcactcagctgagcacctgcaatttcgccaatattaaaattacatcctgatttatcattcttgtaatttgcacatccatagccaaatggcgtggttacaagttctccaccgcatgccggacatctgacaccgatctttcttctcgcaccggcacctcttgcatttttcccggcaaaattactgatacgttccgcaagcggttcccgcagatcctgtccgatcatcttttccgtttcggtccggatgaaatcttccagtttcgtccggtaatcccagaaatccacggttccctgtgtaattccatcaagtcccttttcccaggaagctgtcatcttcgggttcaaaagtgccgggacggtcatgctcaccacttcaaataccatctccccgagattttccggtgtgagcacctgcgtccgtttattcagattgagataatggatgcggaccagtttcttgataatttccgcacgggtggccgaggtaccgattcccgaacctttaatctgttcccgaagctcctcgtcctcaatcagctgtcctgcattttccatggcaagcaccatggaaccagaggtgtaccgcttcggcggtgaagtttttccctctttcacctcatatccatccacggaaatctcatcgccctttttcagctgatctgccagatgtagcagttccttcggatccgaatcttcttcctctttctttggaattcctgcaatttccaaataaccgggtatctttaacacacgtgcggacgcataaaaacgttccttattttcccccacatccacaacagccgtcatttttacattctgatattctgccgccggataaaacacactgagaaatctccgcacgatcagatcaaataccgatttctgcagagcattcagtttcccaagctccgtgagctgaccggtcggaatgatcgcatagtggtctgtcactttagcatcatcggtatactgcgttcctgcaatatttccatacagctttctgtcgagaatctgctccacaaaatccgaagtcggctcatatccccgcagacggctgatatttttatgaatttcctttgccaccggagtagaaagcacacgcgcatcggtacgcggatacgttgtcagtttccgttcatacagatcctgcgccacctgtaaggtttcatccgggctgatcttgaatcgttttgcacattctgcctgcagctctgccagattaaacagtaacggcgcccgttttctggaaatattcttttccatggattccacaatcgcagaatgtccctgcacgcggtcaatcaatgccagtgcatccttcttttcccgaaatccgttttccttatacaaaagcggcgatgcaaagtaccctgatccctcgacggctttccactcgccctgaacatgtgcatctgtaaaatttccgacaacacggtaaaacggtgtctccttaaaattgcggatctcgcgctcacggatcacgaccatcccaagcacacaggtcatcacgcgcccgaccgcaatagcggtgtaggaacgtgttcccgccgcattgtttaacaaccctccatattttaccgacattacacgggaaaaattaatgcccatggcataatcttcaatggtacgcataataccggattttccgagattttcataggcagacatcggttttgcttcccggattccccgttggatctcttcctctgtctgggaatcaatccagacccggagttcctccatgccgtctcgcacaccgccgaaattgcggatattttcctcaatcgtctgtccttcttttccggcatctcctgcccagtagacacggtcgatatcctcgcgcatcaacattccgtgaaccacatcatactgccggctgacatctttgatcacatcatatttatattcttttggaagaaatggcagatcttccagtttccactttttgtattttatatcataactttccggatataccatggctaccagatgtcccacgcaccaggtgatcacatatttctggttttccagatagccatctctgcggcccccgcttaccccgagaacttttgcaaattcctgggcaaccgacggtttctccgttatgatcagtgactttcccatcttctatcccctattggcaaactttttctataattcgttcatatcaatcagctcaaaccggtcatccgttttggcatgctccgccagcatcggttcaaaccgcgttgcagagaataaaaaaatatgctccgaacggatttttgccttttccatgttctgatacagttcctcgcacatctgcgatgtcagctgtggctgatcccagttacatagtcccacaatatttctgcggtctgtgctctgggcaataatatcaatgtttcctgtctttccaacccaggttccgatcttatgaactggaaacggcatgcgtcccatctgattcaaaagcatcatatactccatgcagacattccggaaataacgtttcagatacgtgccaagttccggtgcaatgtaacggtcgtaaaattcatacggtttcagcagataaagatccgacatgtggggaaatacaaatttaaaccagaaattaataaatgtatctttgatctggtataccccttttttggcattctcccagccaccggtctgaaatgactgcactttctctacaatatcaaaatggctgagatttttcatataaacactgatctttgcacgggaatatccggttttcaaatacaggtcattcagtttattatatccctgtgcaattgcagataaaattgtgttatagacggaaagttcacgcagttctgccgaaattttctgttctgccatatgaaacagatatcccccctccgtcagcacaagccggtaaatattctccctgtatgaaatttccggattccatgcttccataaatcccggcaccccaccgatggttccataaatacggatacagtcgctgaccgaaagtgccggaaatgtccggacaacttccaggaaattcagatcttccactttatgcagtacatcaatacgacggaatccgtccccgaacgcatcttttgcatcctgcgtagcccatacaatggaagaagacgccagaatgatcatcaccggtcccggataaagccgtttcatctttaattttaaaatacttttgacaaattccggatctcttttaattgcatactgtgcctcatcaatcacaatcaccaattttgatgcatctccgctttttacccggttaaaaaattcatcataggaatacctgctcagcttcatctgaaaagcattttgaatttcttctcccattttctgcatctgttcctgtgcggaaagctgtctgcaccgataataaaaatactttttccccacacagaattctttgatcagctgttctttccggcagtccatcccaccatacaaaagcatcagctggtttcctgatttttcataccagccttccagttctttgagatctgttttttttgcgttcatcccgattcctccgtacaaaattccttctgctaaaagaaattatatcactgattaatatctctcacaaggttttcggcaaaaagaaagaagtgcagtttttgcacttctctccaaaaatccgtatttcaatttaatacttatttctttgtgatatatccctgtgcctttaacagctctgcacataaaactgcaccaccggctgcaccacgaacggtattgtgagataatccaacgaatttccagtcatatacggtatcctctctcagacgtccgacagagattcccatgccatgctcaaagtttacatccaggctgacctgcggacggtcgtcctcttctaagtactggatgaaatgttccggtgcacttgggagcttcagctcctgtggcacaccactgtaattcttcagtgcttcgatcagctgctctttggtaggtttcttcttgaatttaacaaatacagctgctgtatgtccgtttaataccggcacacggatacactggcaggtaatgactggtgaagttgcaggaacaatctgcttcttctcatcatctacatgcccccagatacgcagaggctctttctcagacttttcttcctcaccaccgatgtatggaataatgtttccaagcatctctggccagtccttgaacgtctttcctgctccggaaatagcctgataggtagtggcaactacttcatacggctcaaactctttccatgcagtcagaaccggcgcataactctggatggagcagtttggctttactgctacgaaaccgcgctttgtaccaagacgctctttctgatacttgataacttccatgtgctgtggattgatttctggaactaccatcggcacatccggtgtccagcggtgggcactgttgttggaaacaaccggtgtctctgtctttgcgtaatcttcctcgatctttttgatctcttctttggtcatgtctacagcagaaaatacaaagtcgacctgagaagctacctgctctacctcatttacattcattactacaatattctttacagcttccggcattggagtatccattttccaacgatctcctactgcctgctcataagtctttcctgcacttcttgggcttgctgcaatcgtggtaacctcaaaccatggatgattctccagcaaagagataaatctctgtcctaccatacctgttccgccaaggataccaacttttaacttctcactcatttttccaatctcctctgttcttttctttatacgcggacacctgtcttttacagaaaaacatttttgttttttgtccgcgttacacgaacatgtgtctttataggaaatatattacttgaaaccaggtaaaattacaaggaacaaattgtcctaaataaataaaatattcctcaaatatatgtaggacttgcacaatctgaaataccgactaagcggtatttcaggcaatatatcagagatgtaccgcaattacgtacatcgcatcgacaagcgattctgcatgcgatgtgctccttttgtctcattttttctccagatatgcctcttcgattgcgatcactttcttcatcgcctcttcccctggtgcaccgatcgtcagacgcttgttgacacaggtttccatggagattgcatcatagacatcctcctcaaataccggagaaaactgttttaattcttccagactcatatcgtcaatcggcatctgtttgtccagacagtacaaaacaatacgtccgataattccatgcgcatcgcggaacggaaccccgtgatttacaagataatcggcagcatccgtcgcgttggtaaagccgtgtgcggcactctttctcataacatccttattgaatttcatggtatcaagcatgcccgtgaataacgcaatacagcctttcgttgtgtcaatggcatcaaaggaaagttccttgtcttcctgcatgtctttattgtaagcaagcggaatccccttcatcgtggtcagaagcgacatgagcgcgccatacacacgcccggtcttgcctcggacaagttctgcaatatccggatttttcttctgtggcatgatactgcttccggtactgtatgcatcatcaatctctacaaatttgtattcgttggaattccagatgatgatttcctcggaaaagcggcttaaatgcatcataatggttgccatggcagacagatattcgatcaggtaatcgcggtcggaaacaccgtccatactgtttaaggtcggtccgtaaaagccaagaagctctgcagtatattcgcggtcaagcggataggttgttcctgccagtgcgccggaaccgagcgggcagtaattcatgcgctcgtaaatatcgtgcatacgggaacggtcacgcttaaacatttcaaagtacgcccccatatgatgtgcgagtgtgatcggctgcgctttctgcaaatgggtaaatcctggcataatcgtctgcgtattttctttcataatgcgaagcagtacctgcagcagctgttccagcagttcatccgtctcaagaacctgctgccgggtatacagacgcatgtccagtgccacctgatcatttctgcttcgtccggtatgcagtttctttccggtatctcccagacggtcaataaggtttgcttccacaaaactgtgaatatcctcatattccgaagtgatggcaagctttccgctctccacatccgcaagaatttcctgtaaacaggaaacaatcgcctgcatctcttcctgtgtcagaatgccctgctttccaagcatacgcacatgtgcaatggaaccctcaatatcctgcttgtaaaatttctgatcaaacgaaatggatgcattaaaattgtaaaccagctggtctgtctccttcgtaaatcttccgccccataactgtgccatatctaaattcctctctttcttaaattctttgttttatttttataaaatctgttcttcctgctgtctgcgcagtacaatttcacggtcgcggtcacgcttggaatacacacacccacagtagtactgccggtacatgtgatactccttagaaatttcggtcgactttttatagccttccttctttttaaaatccgaaaacagataacggacaccaaaggtatctgccagttctgccccgatctgatttaacttttccgcatttttcagcggactgatggatagtgttgtcgtaaagaaatcaaatccgtgcgcttttgcataggacgcagcctcagaaagccgcagccggtaacaggcaaaacagcgctctcccccttccgggatctcttccatgccctttgccatatcgtaaaaccgctgtgtatcgtatgcaccttccacaaaagaaaccggatattttgtaggaaactcagcaataaaacgttcctgctcctttgcccgcatatgatattcttccggcggataaatattgggattgtaataaaataccgttacatggaaatgttctgcaagacatgcaatacaataagaactgcacggtgcacaacagctgtgcaaaaggaggcttggagcctcccctgccgtacagttttcacggatcagatcttccattattttctgataattttttttattcatctttcatctgtatacatctgattaaaaatttcttttccggtctgcgtccggaaaatttgctgatatgcctgttcaattccgtgacgattgacgtcatcttcatataaattgaccagaaaatctgcctccaccagaatctgataatccagtccttcgatattatcatatgtatgatgatgtccgatcagatagcagatacggtcgatcagataattttcaattcccacatcggaaagcattctctgtgccacaatcggtccttcctgctcctgcagctttccgtcacaccgtccatacttttcttctgccggacggattccaatgtcatgggtataagcggctgcttccaatataaaaagggatgtctcgtcaagcccttcttttgttccgatgattcttgcgaaactatgcactttcatgaaatgctgaatccgtttcggatctccggaaaaaaaggcgatcatctgtaaaaacagctcatccagctgttgcctgctgtaataactactgtcactactgtccattgtgtgtttctcctttatctaacatctgcagtgcaaacgtcgctgcaatgtaaacaactgcacataaaataattaatactgttttttccccggcaacaccggcacaaagttctgccagaataagaagtccatgcacccagagttccgcatgatgcagcatcactgcaataactgcctcaatgataacaagcagacacataggaactaccggaacgttaaggactctcacccctacaatcaccataattgcaacaattgctgcaaaggccagtaatgtcggtacctgaaacgtctttttgttcttgtccattttttacctcaacctttattcttattttctttgtctgcgcccattataccaatttcatgcctaagaaacaagcactttttaaagtaaaaaagacacgtcttccatcggatacccgatacaaaacgtgtctgaaacgaagccaataaggggactcgaacccctgacccacgcattacgaatgcgttgctctaccaactgagccatattggcaaaacgtacttgtatataataccaaaaccgattcagaaaatcaactgttttttcataaaatttatattaaaaaaagattgacttttcacatggattctgtagaatagaaactgttgagtttataatcagtaaacaaaaaatcaactaacaatcatgtttcataaatttacgggaggcatgccatggacattggacaccgcatgaaagaactgcgcatccagtacggactgacgcaacaggagctggcggaccgtgccgagctgaccaagggctttatctcacagttggaacgaaaccagaactctccgtccatcggaactcttctggatatcatccagtgccttggtacgacaccagcagaattttttacagatgaagagccggaacagattgttttcaaacaggaagattattttgaaaaaaccgacgaagaaaaacactgctgtattgaatgggtcgttcccaatgcacagaaaaaccagatggaaccggttcgtctgactttacacgccggtggacggtcagaagtttatcagccccatgagggggaggatttcggttatgtaatcacaggaaacgtccgtatccactatgccggacaaaaccagacggtacatgccggggaatctttctattttaaagcaggaaaaaagcattatctagaaaacaccggttcgaaagatgccgtcatcatctgggttactaccccaccaaatttttaagaggacaaacgtatgagtaaacatttaattgattttattggaatttccaaatcctacgattccaatcttgtgttggatgatttaaatctgtatatccgggagaatgaatttctgacccttttaggtccgtccggatgcggaaaaactacaaccctgcgtctgctgggaggctttgaaagcccggacaagggacagattctgtttgacggacaggatatcacagctcttgcagccaatgaacggaaactgaataccgtttttcagaagtattctcttttcccgcatatgtccatcgccgaaaacattgcattcggccttaaaataagtaagaaaagcaaagcatatattcaggataaaatcaaatatgccttaaaactggtcaatctggaaggatttgaaaaccgttcggtcgattctctctccggtggtcagcagcagcgtatcgccatcgcccgtgcgattgtaaacgagccaaaagtccttcttttagatgaacctctcggtgcacttgatttaaaactgcgtcagaacatgcagtatgagctcatccgtctgaaggaagaactgggaattacttttgtatacgtcacccatgaccaggaagaggctctgaccatgtccgataccattgttgtcatgaatcagggatatatccagcagatcggtactccggaaaacatttacaacgaaccggaaaacgcatttgttgccgattttatcggacacagcaatatcattgacggaaccatgataaaagacgaacttgtagagattctcggtgcccgttgggcatgtgtcgacaaaggattcggcaataacaagccggtcgacgttgtcatccgtccggaagatgtagaacttgtcgatccttcggagggaacgctgcagggcgaagtaacctccctgatttttaaaggcgttcactatgaacttgatgtcatggccggcggctatgaatggctggttcacaccaccagatttgttccggtcggcaccaaagtcggcatcaaagtaatcccgttcaatatccagattatgcataagccggaatcttccgatgaaaaggcggtggagatcgatgcgtaaatttaaacagcaatttcttgccggtccatacctcatatggatcatcggttttatcctcctgccgcttatcatgattctttactatgcatttacaaacggcgatggcagttttacgttatcctatatcacagcgatagcagatgaaaccaaccgcaaagccatgggactttccctgagacttggaattatatgcaccatcgtgtgcctggttctctcctatccgctggcaatgattttaaataatatgaaaatcaaaaatcagggactggttgtttttatctttatgcttccgatgtggatgaactttatgctccgtatcctggcatggaaacttctgctttccaaaaatggtgtaatcaactccattctcacaggtttcgggctttcccgcatcaatatcataaatacaccaacggcagttgtccttggcatggtatacgacttcctgccatttatgctgctaccaatctacaactccatgacacgaatccgtaaagactggattgaggcggcccgtgatctgggtgccggaaatgtaaccatctttttaaagattatccttccgcttaccgtatccggaatcatcagcggaatcgtcatggtatttgtcccgtcacttacctcgtttgcaatctcgcaggtattaggcggtggtcatgttcttttaatcggaaatgtgatcgaacaggattttatgcagggtatgcaatggaatgccggaagcggcctttcctttgtcctgatgatctttgtaatcgtaagtatgacaattgtaaatatatttgataaagaaggggagggaacatccatatgttaaaaaaatgtgcatcccggatctatatggtcctgatttttgccttcctttaccttccgattattgtgttgattgctttgtctttcaacgattcccgttccaaggtaaaatggggtggcttcacgctccggtggtataccggctgttttcaggacgaaaagattatgactgcatttgtcacaactttgcaggtcactttcctgtccgcaattatttccacactgatcggaacacttgccgcgctcggcatagccgccatgaaaaaacggcaccagaccatttatctcggcgcgaccaatattccgcttctgaatgcggatatcgtaaccggtatctccatgatgcttttgtttgtgaaatttatcgacctcggatttgtgacggttcttctggcgcacattacttttagtattccttatgttattttaaatgtgcttccgaaaatgaaacagacaaaccgcagcacctatgaggcggcacttgatctcggagcaacgccgctgtatgcattttacaaagtcacctggccggaaatccgtcccggtgtgttctccggatttatgatggcagtcaccatgtcactggatgatttttccatcacctattttaccaaaggagccggggtcaataccctctccaccatgctctacacagaacttcgcaaaggaatcaaaccggaattgtatgcactttccacgattctgttctttgccgttctgctcattcttcttgccggaaatgtttatccggggaagaagcgtgttgcagccaaataaattatccattggaattttattccagccgaaaggagtcctattatgaaaaaaagaattttctctgccctcttaatttctgctctggcagtcagcgcactcactgcctgtgggggatcttcctctgcgaaaaaaaacggacagaccttaaccgttttaaattacggaaaatatatcgatgagtccgtagtcaaacagtttgaaaaagaaaccggtatcaccgtcaaatacgaagaatatgaaagtccggaagaaatgtataccaaatacaaagctggttccatcaactatgatgtaatctgctcttccgaatatatggttgagcgtctgatcaacgagggcgaagttctcgaagaagattacgatgccatggacaactacaaaaatctggatccaacgatccttgatatgtctgcttcctatgacaagaatcacacttactccgttccatatttttacgggactcttggccttctctacaacaaaacaaccattgatgccaaaaccgtatcaagctggaactgcctgtgggatcctacctatgaggatgaaatcatcatggaaaattccgtccgtgatacgtttgcccctgcactgatctccaaagggtattccttaaacgataccgatgaaaatcatctgcgggaagccctcgacatattaaaaaagcaaaaagatgataaaatcgtatatgcttactatgtagacgagacagccgatgccatgatcggagaagaagcctccatcgcactgtgctactccggcgaggctgcactggccatggcagagaacgacaatctggattattcggttccaaaagagggatccaacctctggatcgattcctggttcattccaaagtcctgcactaaccagaccaacgctttaaaattcttaaatttcctgtgcaaggatgatatcgcagaaaagaatttcgaatatgtgcagtatgcctctccgattacatctgtggtagaaaatcaggacgctgacgtaaaaaataacgaagctatcaatccttccagtgacacgataaaaagatgtgaaatctataaagcattaagtgatgatgattccgccaagtacacaaagctgtggcaggaacttctctcttattaaaaaaccgagaaaaatgattgcaatttcagtcaaaacatgctaaagtaaatccacggtgtctggttaacaccgtggatttttcatcttcggaaacggtcattccgaaatttcccatatatacatttgttttcaattacatatgaactatcaggaatttttaacaacgatccgtacacagctttctctgcgtatcgagacaggtgtcactttagacattcgttcctttaccaaaaataacggaacacattacgatggtctggtacttctccatccgaagaaaaacgtgtcacctgcgatctatctgatgccatactatcatcgctatctggaaggggtatgccttgaagaaatctgtgaagatattcttcatacctatcaggcgcatgccccggaagaaaattttgacacgtcctactttaccgatttttcccgtgccagcgagcacatcgtcatgcgtcttgtaagctttgaaaaaaatcaggaactgttaaaagaggttccgtttttccgctaccaggatctggccgtaatcttttactgtctgctccatgcaagtgccgaaaaccaggcaaatattctgatccacaatcatcacttaaacctttggaaaaccgacaaagaaacgctttaccggcttgcgaagaaaaacacgccacagcttcttcccccacagcttaccccgatgagcagtcttctcaaagaaatgcagctcgtcgcggaaactccactcccggaagcagccccgccactgtatgttctgaccaatacgtaccggaccaacggtgcaaccgttctcctctacgatgacatcttaaaagaactgtccgatttgtttgaaaaggatctgatcattctgccaagcagtattcacgaagtactgattcttgccaccgatgaaaacgacaggcagaatctcgaccattacaccgcaatggtaaaagaagtgaatgcctcacagcttcaggatgaagaaattctgtccgaccatgcctactattactgccggcacagccatctgctgaccatgccgcagccggtctgcacttcatagattatatttccagacacaaaatccccgcagaaaaaattctgcggggaacatctattacatttctaccagtttatcatatagcttctcatatgcatgtgccgaagcattccaggaaaaattgcgatccatcgcacgatagatcagttctttccatgcggccttttgttcatgctccacacgatacgcataccggacaatatctgccatttcctgtgcattaaaattcgcaaatgaaaaaccacatcctgtattttcatattcattgtatggttctaccgtatcccggagtcctccggtttcacgtacgatcggaagtgttccgtaacgcatggcaatcatctgtgccagcccgcatggttcaaacatggaaggcatcagcagcacatcacttgccgcatatatatggtgcgaacgctcctcggtaaatccgatatgtacgcttaccttgtccggatacttactctgataatggtggaacatattttcatactggctctctccggaaccaagaaccaccagctgtatatccatttcggttaaaagttcatccaatacgcagccaatcaggtcaaatcctttctggctggtcatacgcgatacgattccgatcaggaaagcatcctccctgactggaagcccaagttctttctgtaatgcagctttgttttcttttttcccactcactgcatcttttttcgaataatttaccgaaatataaggatctgtctgtggattatattcttcataatcaattccgtttaaaataccataaaggcgatcctttcgggcagtcatcaagccacttaagccctctcccccttctacggtcgtaatctcatttgcatacgtcgggctgacggtagtaatataatccgcatataccacgccaccctttaagtagtttgcttcgccataagattccagttcatatgcattgaaaatgtgtgccgggagtcctgtaatatccataatctcctgaattcgccagcgtccctgaaactgcaggttatgaatcgtaaacacggttttgattcccgcataaaaattatcatctccaaataccgtatgcagaaacaccggaataagtcctgtctgccagtcattgcaatggataatatccggggcaaaatcaatatacggcagactagcaagtactgccttggaaaaatatgcaaacttttccacatcttcatagatattgttgtatggagattctcctgcaaaataaaattcattgtccacaaaataaaagtgaacaccatgatattccgactcgaaaattccaacatactgcctgcgccagttcagatttacataaaaatggcacaaaaattttaaatttggaagaaatgagcgatccatgcaggcgtatttcggaataactacccgcacatcatactcttttttgtcaaaatatttcggaagtgatccaacaacatcggcaagacctccggttttcacatatggcactgcctctgatgaaacaaacagaatcttcttcatacataacactcctttacttactcttcatctgtaatcgtattttgtccgtaataagagcgataaattccgagttggtcggttttccttttccattgctgatcgtatatccgaacagatcatccagcgtatccatcttgccacggctccatgctacttcaattgcatgacggatggcacgctcgacacggcttggtgtcgtatcaaatttctttgcaatccccggatataaaattttcgtaatagaatttaacatgtccatattcgtcacagacatgatgattgcctcccgcaaatactggtatcccttgatatgtgccggaacaccaacctcatgaattatctctgtgacatcctcttccagtgtctgtaacgagtacttttccggtttcttttccatctcaaccggtctgccaatttcttttcgtactttgttttttcgacggttgagtgtcttgatccggtccaaaacaatattccggtcaaacggcttcataatgtaataatccgctccccgctcaaacgcgtcttcggtaatcttttcattgctgatcccactgatcatcagaaatgttggccgattctttagtgtatgatctgccctgatcctgtcaaggactgccagaccgtccagtttcggcataataatatccaataatacaacatccggttctttttccttgatcagatggcaggcttcttctccatccttcgccatcccgatcaggtgcagttcatcatcactggttaccatttcttccaataagtcacgcataacctcgttatcatctgcaattgcgacatttagttttcccatgtaggcctcctagaatgtcaaattcagtcaaaaataagcataccagaaagcactgtccgattttgtcaaaatttgtcgataaatacagttaaactatagcacaactgccaatttatttcaatgtcttatgcattctcttcgaactgggaattatacaaatctgcataaaatcccttttgtaccagaagctgttcgtgtgtcccctgctctatgatatcgccatctttcatcaccagaatcagatccgcatttcttatcgtagagagtcgatgcgcaatgataaagctggtccgtccacgcatcagattatccaatgccttctgaatccgcacttcggtacgggtatctaccgaagaggttgcctcatccagaatcagaatcgggttatccgcaaggatagcacgtgcaattgtaagaagctgtttctgtccctgggaaacattacttgcatcctcgtttaactccatctggtagccacccggaagtgtctggataaaatggtgggcatgtgcggcttttgccgcctcaatcacttcctcatctgtggcatctaaacggccataccggatgttttccatgatagatcccttaaacagccaggtatcctgcaataccataccaaatgcatcccgaagttcctgacggttaaagtcgcggatatcatgcccatccacctgaatggctccgcctgtcacatcatagaaacgcataagcagtttgaccattgtggtttttcctgctcccgttggtccgacaattgcaattttctgtccaggtgttacatgagcggaaaaatccctgataatgatctggcccggattgtatccgaaacttacatgggaaaaatccacgtaaccatccacatggtcgagatgcacagcatgttcaaccgtcagttcttcttcctcttcgtccagaaattcaaatacgcgctcggaggctgcagacatcgactgcagcatatttgccacctgcgcaatctgctggatcggctgagtaaaattccggacatactgaataaatgcctgaatttcaccaaccccgatggttccgcggattgccagaagtcctccggaaattgccactccgacataaccgaggtttccgacaaactgcatgatcggctgcatcagtccggataaaaactgggacttccatgccgattgaaacagaatctgattggtatcttcaaattttttgatggtgctctcctgcttattatatgcctgcaccaccagatgtccgccatagacctcttccacctgtccgttgatatgtcccagatattcctgctgctggcggaaatatttctgcgaatgtttgataataaacgaaatcaggatggcagataccggaagaatcacaagtgaaatcaatgtcataattccggaaattgaaatcatcatcacaagtgttccgaccagtgttgccacactcgtaatgatctgcgtcacactctgatttaaactctgtccaagtgtatccacatcatttgtgatgcgggatagcacctctccgtacgtgcggctctcgaaatatttcattggcatgcggttgattttctctgaaatttccttacgcatgcggtaacaggttttctgcgtgattcctgtcatgatcattccctgtataaaactgaatactgcagaacagatatacaggccaagtgtaaacaataacactttggcaatataggtaaaatcaatagatccggttcccgcgatcttttttccgagaccttccaccaatgcattcgttgcacgtgccataacctttggtccggcaacggaaaagacggtagacaccgccgcaaaaatcataacggcaacgattgcataccagtatcttccgagataacgaaccagtttttcgatagagtttttgaaatcttttggcttttctcccggcatcattcctctgcccgggccgcccatcggaccgtgaggtcttcttgtacgttgttctgccatcttatttcacctcctcagaaagtcccagttctttggcagacagctggctcctggcaatctgctcgtaaacttcgcaattgtgcagtaattcctcatgcgtgccttttccgacaatctttccatcgtcgagtaccagtatctggtccgcatgcagaattgtactgattcgctgtgcgacaatgatcacggtcgtatgttccgtctttgtctcaagcgctctgcggagtgccgcatcggtcttcatatccagagcggaaaaactgtcatcaaacacataaatctttggattttttgcaattgctctggcaatggcaagccgctgcttctgtccgccggaaacattgcttccgccctgtgcaatcgcactctcatacccatcctgtttgctgtcaataaactctgttgcctgcgcaatctccgctgcttcccggatctgctcatctgacgcatcctctgccccgaagcgcagattgcttgcaattgtaccggagaaaagaattcccttctgtggtacaaatccgatatgttcccgcagatcctgcaatgtatacttgcggatatccgttccgtcaagcgtgatctctccgcctgtcacatcataaaaacgcggaagcaggttgaccagcgtagatttaccacatccggtacttccgataattgcagtggtctttcccggctctgcaacaaaatcaatatccgaaagcacatcttccgtggctcccggataccggaaatttacatgatgaaaggcaatcacaccctcacactgttccatggcaaccggctctttcggatctgtaatcgtactttttgtgcctacaacctcatctatacgctctgcagctacaccggctctcggcatcatgatagacatcatggtcagcatcagaaatgccataacgatcatcattgtgtaagtaataaatgccgtcatggaaccaacctgcatatatccgccatcgatcctctttgcggcaacccacacaatcagaagcgtaatgcagtacatgatcatcatcattcccggcatcataaatgtcataacacggttggtaaacaactgcgtctttgtcagattgcggttggcctcatcaaaccgctcttcttcccgtttttcccgtccaaatgcacgaatgacatttaatcctgtcagaatctctctcgaaaccagattcagccggtccacgagattctgcataatcttaaacttcggcatggcaagggaggtaagaagcattacaaatccaagaataacaagcaccgcaagcgcgatcacccattccattcctgcatgggtctgtgcaaccttaatcacaccaccgattccaatgatcggagcataaagaatcattcgcagaaatactgcagtcaccatctgaatctgctgtacatcattggtacttctcgtaatcagggatgccgttgaaaaatgatccatctctgcattggagtactgtacaacattgcggaatgtcttatcacgcagatcccgtccgatggatgctcccacacgggaagcacaatatccgacaaccactgccgccataaccatcagcagcgcaaaaccaagcatctttgctccggtggtccataagtaatgtttctgaatggcatctacatccacacctgcatttttatcacaggagatcgcataggtcacacccatggatttcaatgtagaagatccgatcgcatcaatctgtccagacacctgctttcgcatctcaagaatctgctgatccggtacctggccggctgccagtgcctgcatcagctgcttcatatctacctgcgtcccatccgttcccattttccccgtgaaagccttctcgtcaatatcggactccttcatctgggacatctgatataccatgacgatcggctccaacagagactcatccatatcgtcaagcgtatcctcttcacaatttctcacatagtttccatcttttttcggctccttataacaggcggcaaatgttttcttttccctgctggtcataaaaagctgtgctgacacaaaatcttcctgtgtcatttcttctggaagaatatgctccactccgctgctcatgattccgacatcgataatatccgatgtatactgtggcagggacagatcacaaaatgcctgcatcgcaagaaaagccacaataaccagaatccatttccagtatgggagcatgtttttaaatatttttcccatgatttaactccttttcatatgcatagcttttatactatcacgaactgatttccagaacaattcctattatataaaacttttcttaaattaaaatgaaatgtgtggtgcaaccatgggcaccacacattttatgttctgattttatactgctggaattatataaccggccttcttcatttcttttgtaaaatcatcgacagacattcctgctttttctgcaccaatttccactgtaatgattccatcctgtaccagggatgcatatgcacgaatctttccctcgcgctgtccttcgattcgaccttccacacgttcctcattcaattcatccgccattaaaacacgtaatgcctcacacataatcctttcacttcctttccatttttgcactttctccatgttactgtttacaataacctggagcacaacatctgcaagattcttctctctttccgaaaatgcactcaccctcaataaatactgacgcatcaacgattcttccagatgattcgtcaatgcttttagctgtacatgcatatccacatccagttccgatgacgctatgatctgcaccggaaacatcactccactgacatagtaaatccctactgtttcttttttacattcatacccggatttttccagttcctgcatcagcttcaccggcttccgatcacgaatcagtgtaatggtaatctcctctgccggaatctcatccacatgatttggtaatactttatacaggcacgcatacgcaaccgccttgtaaaaagtatcaatgttcagctcatccatcggggatttatattcaaaaatattgtgtttccggaagatcttcccgatttcattttttattttgcagtccttctttacttttacaaccgtacagtcaatctgcaaaggtttctccgtaagctggaactcatcggtaaattccaaattttctgcatcctccagcagttccagacgcaaggcggaacagaatgccggatgccactgcagcttttgggactttttctgattcttctgttgatttttcgtttgttctttttccaaatgttctccttatattatatgtggtttttgcttttatttcaacgcacaaaaattgcagactgttaaaccctgaccgtcaatctccgaccgtcaaaacctgactgttaaaacctgaccgtcaaaggcacattaaagttcacatctttcacttatacaacaaaacaaatgggatttctggcagaaactgccactgaaaaaagatatgattactataccatatgtttatgaccactgcaagaaaaaacatcccgagctggaaaaacaataggaaaaacaaaaagccatgcaatggaaaaatccaatactgcatggctttacaaaattaattttataccgcagggattacataacctgccagcttcatttcctttgtgaaatctccgacagacattcccgctttttctgcacctgtttccacggtgatgatcccatcctgcaccagggatgcatatgcacgaatcagtccttcgcgctgaccttccactcttccttcgcgctgaccttccatacgctcctcattcaattcatctgccatcaaaacacgtaatgcctcacacatgatcctttcacttcctttccattcccgtactttctccatgttactgtttacaatgacctgcagcacgatatctgcaagattcttctccctctctgcaaatgcactgacttctaacagatactgtctcatcactgtttcgttcagttgattcgtcaatgcttttagctgtacatgcatctccgtgtccagttccgatgacacaatgatctgcaccgggaacatcgcgccattgacatagtaaatcccggctgtttcttttttacatccatacccggatttttccagttcatgcatcagcttcaccggcttgcggtctcgaatcagtgtaatggtaatctcctctgccggaatctcatccacatgatttggtaatactttatacaggcatgcatacgcaaccgccttgtaaaaagtatcaatgttcagctcatccttcggggatttatattcaaaaatgttgtgtttccggaagatcttcccgatttcattttttattttgcagtccctctttacttttacaaccgtacagtcaatctgcaaaggtttttccgtaagctggaactcatcggtaaattccagattttctgcatcctccagcagttccaggcgcaaggccgaacagaatgccggatgccactgcagcttttgggactttttctgattctcctgttgattcttcgtttgttctttttccaaatgttctccttatattatatgtggtttttgcttttatttcaacgcataaaaattgcagactgttaaaccccgaccgtcaaactcagaccgtcaaaacctgaccgtcaaaggcacatcaaagttcacatctttcacttatacaacaaaacaaatggaatttctggcaggaactgccactgaaaaaagatatgtttactataccatatgtttatgaccgctgcaagaaaaaacatcccgggctggaaaaaccaaaagccatgcaatggaaaatccaatactgcatggctttacaaatttgattttacaccacagggattacataacctgcctgcttcatttcttttgtaaaatcatcgacagacattcctgctttctctgcacctgtttccacggggatgatcccatcctgcaccagggatgcatatgcacgaatctgtccttcgcgctgaccttcgcgctggccttcaattctgccctctcgctgaccttccatacgttcctcattcaattcatctgccatcaaaacgcgtaatgcctcacacatgattctttcacttcctttccatttttgcactttctccatgtaactgtttacaatgacctgcaacacaacatccgcaagatccttttccctctctgcaaatgcaccgacctctaacaaatattgcctcatcagaaaaacagttcagagcaaataaaataaaatttcctgtttgcatactctccaaaaagaggtattatatagaaaaacacaggaggtattcaaatgaaagcacataaatattggtcccttggtgcattggcaaccatgatcggaactatctataccggctataaaaatatgaaatcagctcacaaatattttgcctgcagttctcttctctgcatgattatggctatctactctggtcataaaatgctttctgcaaaatccaggaaaaagaaagactctgtttctcaagaatccgcagaataattgaaattatagatgtttttacccatacatactacatggctttacaaaatgattttataccgcagggattacataaccagcctgtttcatttcttttgtaaagtcatcgacagacattcctgctttttctgcaccaacttccactgtaatgattccatcctttaccaaagttgcatatgcacgaatctggccttcacgctgaccttccacgcgttcttcattcaattcatctgccattaaaacacgtaatgcctcacacattgtctgttcacttcctttccatttttgcactttctccatgttactgtttacaataacctgaagcacaacatccgcaagattcttttccctctctgtaaaaacgctaacttcctgcagatacttccacatcagcggttcatccaaattgtcagtcagtgccttgagctgtacatgcaaatccatatccagttccgatgatgcaatgatctgcaccgggaacatcacaccactgacataatagattccggctgtttctttcctgcattcatacccatcactacttaatttctgaagaagcttcaccggcttccgatcacgaatcagtgtaatggtaatctcctctgccggaatctcatccacatgatttggcaatactttatacaggcacgcatacgcaaccgccttgtaaaaagtatcaatgttcagctcatccatcggggatttatattcaaaaatattatactttcgaaagatcttcccgatttcattttttatcctgcagtttttctttactttgacaaccgtacagtcaatctgcaaaggtttttccgtaagctggaactcatcggtaaattccagttgatatttcacatattttaggaaatttaataactgttatatttaattatcaaattcttcgcaaacccttgaaaatactaagtttgtagcaagtgagctttcccttactctttcccttgtgttatattctcacattggttttcatgaaccttaatatgggaaaaaataagggaaagaaaatttcataacacagtataacaataacgacatggtgaactgattgaaatgttttcgatatttaactctataactgattattaaaagaaaatggagataagatacgatgagaacaatttatgcagaatacaacataaatcacgatagtattgatgtttacacaagtgccggatatatgcttcgcattgattgctggaaagctgaaaaaaatctaaaaaccacatacggatcagaatgtgcgcttacttcattggctgtggatgagcctttggaatatgcaagattatatcttgagggtaatttacagatgtgggtagatgcagaagactcactagagttataatccttatccatataaataatatgcaaatatatatcccatcaatatagcgaatatactgaaataaaagtatctttataatcaattttaaccaaaagaatatgttcttagaggaggtgtctcccgaaagaacatattcttctattatgggtaattataaatatagaacatgcttttcttgtgctacaatttcttcactatgagttacaacaataactgtttttccctgttcacttaactcatgcaatatattcataacaatctcactattttttttgtctaaggaaccagttggttcgtctgctaatacaatcgaacatttctttagcattaaacgagctaacgcaactctctgctgttcgccaccagataattgatagacttttttgttaattactttctgtaaaccaactttttcaagagcttcatttattgaaatatccgttctacctgatttttttattatttctagattttcttttactgttttgttttccaaaagggcaaaattttgaaataaaaatccaacaacttctttgaaatatttctgcttttttcctttttttgccacatcaaaaccattcacaataatagaacctttgtcaggagtttcaatacctccaatcatattaagtaaagtactttttccgcatccactttcgccactaattaccaaaaaacggctatctggaatttccaaatgaaaatttttgaacaaaattttatcattatatgctttgcatagattttcaattgttatcataagcaacctccttttaatgatttcggtatgtttgttttttcaacaattgtgatattaaagaaaataattgtaaattctattagtgccataaatgaactaacaagaatgctaattcctacttcagtctgtaccgataataaagaatagataagcatacctactaatatcacaaaattttccactacaatcattttaagaagtgttttgtgccgttcaaataaactatatccaaagattttcatcaaggaaattttcattgcattttctcggaactctagtctacttactgtaacaataatcataatatttaaaagcaatacaatcgtacaaagagaacttaaaaatcccacgagttttattaaaaatgtgtgattatataaatactgttcatgtacgtttgtaattactagctgataatttccaagcatatcttcatactttttgctgatatttcttagctgtttttcatcacattgaaataaaactgctcctgctttatagctttcaagatacccaccattgactgctaaatctttgtttgcctgataaataattatcggatttttgcttttttcgataccatttattctacttgtatctaaataggaaaagtattctgtttcgctatactctatgtactgaatatttaattgttgtaaattatcatgatttaaaacatggctcaaggagtcataggctaattgcttgtttttagcaaaatatctattctttggaatgaaaataatcaaatcagaagattcattctctactgcatttatctgcttcgtaaaaccttgtaacatatcttttgcatgattatttacatatatcacatcatttttatcatttaaaatattcaagcatattacaggctttaatgtgttatattcattcttgtatagtttattccaaaaagcttcttctttttcagcattaaaatcagtagtctttacggtaaaataatttgcatcataatattcttctaacaaatgttcatttgtaaataggttattatgaatactactaatattagtgataattgtaaaaacagcggctacccctgctataaattttaacgaataaattaaaaaatccactcctcttttgtgtgttgcatttgcgaatgcctttctaatatcaaaaaagcaaaaagaacaatatggaatagtggaaagaataattccaatggaatataaaattgtgacgagtctattctcatatgctcccgatatataatttgacagcaatatttttgcaacaataaataatgcaatgtcaaaagttacatcgaataaagcagccttaaatgctatgaaaccagcactttctcctaaggaaactcgtacaacaacctctttttttcgcctaaccacttcaattacatttagaacaatcatcaatgcaataatcataccccatataataaaaatcatgtccttttccgtagaattccaatattctggataagttaagctatatttttctgataatttctgatatgcagagataatattgtcctcatttcctatgtatgagataaagttttcataacccacagaggtactttgcaattctgagagattatgaaattttactttcgtaattccggaaactaaagcggtatattctgattcttctatgtttgcagtattttttaatgtttgtctgattactttatcatcgccataaatatgaagtgttgaaaggtatttattattgatttcattgtactgagaaaaaatatgtacatcattctccgttgcagtttctgatacatctttcagaaactgcgacatatcttcactagcaacttcatagcgtgatgacgtaaaatatgctgtagaaaagttccaaagctgatcttgaaatatttcagattgcataagtattccaaaaatcaggaaacaaaacaaacataagtttttaattgctttcatttatttcaaccccagattccatactttatttgctttttcaaatatcgtagtcaatattgtgctattttcatcaacaatccattgatcttcttgatcttcagcttttttgctacttgacaacataatttgagtattcaaatccttatagtcattaaatagcacgccttgacttattccttggtgaaatggttttatccaaataattagtgcatatcgaacatctgactcagctatcgcaagatttccattccaaagcaaataatcagggacagacacactatactggaatccatctttatctgtgtaaatttttactccagattcttctatttcagggaagtctttctgaaattcgttatatggtttataactcccgaagtaccaaaataaattatagcaacagaacaaaataaccaaaacaattcctatatattttatttttttcttcatttatatacactccacaaaaaagagtggttggaattccaaccactcagccattatcccgaacctttgtttagtagctattaccgtaggtaatactatttcctttatgagcaacctcaattttagaccaattacctttaccaacatttgaacccgaaaaagaaccatttccatttttgacatatgcgtaatgatctttagttgaatgatatgcgtgtgcataatcttcattaatagcaagagtattataaccataagtcaaaacaccttttccgccatcagatgtagtgctcaattcccactttttatcaaatgtcttattcccgtttgtaacagaaaatgccattactggaattgatgaagaaattaacattgcactaatagctacccctacaatcactttctttgctctcataagttttacctcatttgatctgctgtatttctatttatattttatcaaatattttgtatctagtcaatcagtatcttgacttatatagcgtcgaattgtaagatatattccttgtaaaattaaccaaaagaacaacagatttattgataatgcttttttaattacttctccaaaataaatgatgacagccgcacttgtcagtatcatcagtagggtaataacatcccaacagtttttcttatataattctataacctttatttctatcagtatcgccagtattcctgtccctgccacacatattcccacaaccaatatcagcaataaccaatatatgattccggctataatctcatttggaatttttgtgctgatttgtgccacagattgcccggcatcaatcgtccaaccaataaaagtttgtatgaatgatgctgcatcatggaagaatgatttgcaatcggaaaggaacacatctgactgtactgcctgaaaaagagtggttgtcagcgaataccatgcaagaaggaacaaggttgtttggaacattaccgtttttgctttatattgtcctgcaagttgctctttttgtgtttcgtatcttgcttttgcattctgataggctgtccggtcacaggcttcgcattttttatagagtaccggcttttctaccggtatctctacgattttctgatgtgtccgggcataatcccgttgttgtgttaagcatcgtattttatcttgacattcctctatcgtgacgtttgcgcttcgcagcttctctttctcgctccgcaatgctctgtctgccagcttcaagtcgttctttaatgcttgaatattcccggctctgttctctttgtttaatttctcgttcaaggtcagagattcgttgagctgcgtcttcagttccacgataagctggtctttctgttccaactcttcttgtatctcctcggtcaagagcagaagttcttccaactgttcggcgttctttaattctctggattcgttcatctatatcacgtcctttctctacctgctgttccagttcagcaattcggtgttctgtttcagtaataaactgttttcgctgttcagcttctgtgccaatatctgccattgctgattttcgttttccaaaagttctatcttcgttttctgttcttccatcttggaaagcagttcctcggtatttggcaaaatgttgagcagctcggataactcgctgtttaatttttgcaatttctgattctgttcctgcataagagagagttgggtgtcccggttctgcatttccagaagcatttctgccattaaggtctgctgttcttcgatttgcccaatcatagattccattaagggtataatttcccggctttcttctaatgtcatttaatcgctccttccataatgataatgcaccagatactttcccaaaggtgtccagtatcttttgcaataacgtgttttgttgttttatgatttgattttccgctactttccacgaaccttttatttcctgcccggcaagaaacttctgttcaatctttcttgcgtcagcaccttcatggatggtagggatctggagttttccctgcttttcataagaacggtgatcgacctgattatgcaaaggcagatgttcattacacacctttgcccactcgctccgccacagttcacagttttttggattgttccatcccgtagcatcggtcagtacccgtttccattgcaggcggtttcttgcaccaatcttctggattccgttttcatctaatacagggatacggattccatgacggtcagggtttttcttatcctgccaccagttcggatgggattcatcaatcacgatatttccgcttttatctctgacaaaaccccaatctttgacttctttcttcccccaagaatgatccgggttaaaagggcgcattgtcagaagcagatggacatgaggattgccatcccctttgtcgtggatactccaatcagcacacattcccttatccacaaatgtttttttgatatagtcggctgtatattgaatctgttcctgtctgctccattcttttgggagggcaaattcaaatgacctgccaagttgggcatctgcacttttttcaatcttcaatacctcattccataaccgttgtttctgaaatgtgattttaaatttttctaaagcagcttctttatcttctgaccttttgtatcggacagatttttgaaagcgttttatattttcttctggtactatctgccattcaggaggtgcgttttcgcacatcatcagactggtgtagaccacttcttttttagaagtgtaataactgattctcccggtttcctcgtttttcatcacatccccattgagatatgcggaagcggagataacagatttccctttacttcgtccgactattttgactgtgtaatgaaaaatcgccatgtctggattcctcctttctgcacatccggcatagatttccggcaacattgctttcagttttagaaaaagcagtattgccggaacgccctctgcgtaagagtgccctgcgcatagcagcctgcatggaatgcgcccctctggcgaagagtgcctcctgcggcatgagcaggtctggctgaaagccccgccgacggaacgagcccggcaagcgtgagcgaagaccggttgccacttgtggcaaacttattgggacgacctctggttgtccataagtgcgcccttcatgaaaaagcaatgaagggaatgaaaaactcatcccccccccgccattacacttcctccatatcggtatgtgtttctttctgcattgcctttgaaaaaaatttcccattggcttcctgctttttcagaaaaccaatcagctttgggatgtcctcttcctcgataggcgcaccgagaacggattccaccgcaccgccaacctgacagagcctatgggttcgttttttactttcttcggctttctttcgtttcagaagttctttcttctgtgctgcatatcgttttgctttttcaaggctttcctgttccttcttttccatttcaagcattcgttcttcataactttttgttgattttgccatgattacattcccctttcttttacaaagctgacttgaaaaagtaaattccagtgcaagagtaaattccatcggcttttaaattttgctgattttgcaggagtttttttaacaaaatctcttgctttctgttataattaagctagcttatcgaaattttgttgtttttatggcatgaaaaacaggctactggaattcggtgtgtcagactaaattccaccagccacatttaaaaaatgtgaaatgtttacttccagtctgacagcagatttcgatcagttaattagttacttcttaaagcgtatcagcttaggcgttaaattgacttcatctggtgaaaccggcttgagctgaaaggctttaagaacatcttctccaagtgtttccagggcagcatcatacggcgttttgccgtcaaggctttctcttggagtagagtttatgtgattcacaataagattgacatcccattgggttagaaattcaaaggatgttcctttaggcaatatcatgcggagcatggtatgcgcctgttcgatggttcctttttgtccgctacgcattggatcacagtaataaatgctgcttctttgtatgccggtaattccagtttctaattcttctgggttcccaaattcagagccacggtcggttaagatattttcaaaaacagatgtaaattcatacgttcccatacgtttttccaaacggtcaaatacagcacggacggcaccttttgtgcaccggttaataagaaatgcaagaaacagtttttcctctgtaaagatcatggttaacagcgttttctgggagtcccttgatgactttactgtgtccatttgtacataagaatttaattccaaagaacagaagtctgcataggttctgttggtaaatacttcgcggtctttgatctgtgttttgtggcactttcttggtttgaattttgcctgccttttcagatctacatttctggctgtgaacagtcccttatcgatgtatgtgtacatggagcggacagacatatccagttccggatgattgatcaggatctgatagggtgactgtccctgtgcgatcaacggagtaacaatctggtctttttggtgcagctgatgccgggtcatatttatcccggcacgggaactacttaataattcgcggtacttacggtcggcaaaacgggcatcatagcggtatttatgggcaatggtacaatgattgattttcattggacagccattacatacataaggcgccttatcaagtctgcagcaccgttccttttcgaaatccttacaggtttggttgcaggttggacaggatgtacatttaataccgcagagcatgatttttccacaggcatttgtttttttacagtgatagcggtgtacacaaaagtttttggcattgtagaaagttcctttgtggtaccagtcagaaaggcgtcgtgatttaacctcttttgagatggttgtaggatctttacaaaggaatgccgcaatgtctttaaaagtcgcacctttggataattcgttttcgatgtagatacggtcattaagtgttagatgtttctggtttccagggatatatttactcatgataattctccttctactgctgtcagaaggaacttttacaataacactgatgtatgaaagagtaaatatctactgtgcaggactaaattctaccgccctgtagggcagtggaatttaaaatttcattttaggtttcttttacaaacataagttctcggttgcgtatcagaagaagcacatggtataatcttcttgcgtgtaggtatatcatggcttcggtctgatagaacctttggcggtttctttggaagccgcctttttaatttgccgcagttcttgttacggcttttacatttcctctatccctcaaatcacgaccttcattcgcttccataaacatttccagaatatcggttttaatcaggactttgcgaccaacctttaatactggaagtttcttccattctacaagctgtcttaaggtgtttctgccgattcccgtatagtcagcagcttcttcgatggataatgcaatttttctttgcgtcatataatcacctccttataaattgcattatgcaattcttgtgatgtaagtatatccttttcatatctttttgtcaagcgttacgaaatattaaaaataatttttaagttgcatattgcaattacagaaaaacaatgctataattcatacataccgaaaaaggaggcagtcagcatgaaagataaagaactacgcaagctgataggcagcagagtaaaacagcgccgtctggaattgaatctgacacagccttatgtcgcagaaaagatgggtgttaccgcttctacaatcctgcgttatgagaatggttcgattgacaatacgaaaaaaatggtgctggaaggtctttcggaagcactccatgtatctgtggaatggctcaaaggggaaacagatgaatatgaaaccgacattacggataagagagagttacagattcgtgatgcgatgggagatattctggaacagttaccgcttgcccttaccaaagaagaagatgctttttcaaaagatttattactgctgatgttaaaacaatatggtctgtttttggattccttccagttcgcctgcaaaaacttcaaggggaatgctggtcagacggatattgccaaaacaatagggtttgaatcgaatgatgaatataatgagattatgttcttaagggaaatcactcacaccatcaatgcttttaatgagatggcagacgttgtaaggctctattccaagaaaccaaaaacagcagaacaaaggcttgcaaatcttttatcagaagtcttatacgaagattccgaatcggtatagtaagacaaccggagttatgatatacttacacgcacgaagcatttcatcagttccgattgtctaatatcgaaaggagacatacgattatggcaaaaggatctgtaagaaaaaaaggaaagaaatggtactaccgcttctatgtagaggacgcaagcggcaatcttgttcagaaagaatgcgttggaacagaaagcaaaagtgaaactgaaaagctgctccgtcaggcaatggatgattatgagaaaaagaaatttgttgccaaagcggaaaatctcacagtcggacagcttttggatgtgtgggcagaggaggaattaaaaacaggtacgctcagcaatggtacggtggagaattacctcggaacaatccgaaatatcaagaaacacccattggcagaacggaaactgaaaaatgtaacctctgaacatttgcaatccttcttcgatttgctttccttcgggggagttcatcccgacggaaaagagagaaagggttacagcaaagattatatccattctttttccgcagtcatgcagcagtccttccgttttgcagtatttccaaagcagtatattacgttcaatcccatgcagtatattaaactgcggtatcagacggatgaagtggatttgttttccgatgaggatatggacggaaatgtccaaccaatttcacgagaagattatgaaagattgcttgcttatctgcaaaaaaagaacccagccgcaatacttccaatccagatagcctattatgccgggcttcgtattggagaagcctgcggtttggcatggcaggacgtaaatctggaagaacaatgccttaccataagacgcagcatccgatatgatggctcaaagcgcaaatatatcatcggaccaaccaagcggaaaaaagtaagggttgttgattttggagatacactggtagagattttccgtaatgcccggaaagagcagttaaaaaatcgaatgcagtacggagaactttatcacacgaactactacaaagaggtcaaagagaaaaacagagtgtactacgaatattattgtttagacagaacagaggaagtcccgacagattataaagaaatttctttcgtctgtttaagaccggatggttgtttggaacttccaactactttggggactgtttgcagaaaggtggcaaaaacattagagggatttgaaggctttcatttccaccagttacgtcacacctatacaagcaaccttttagcaaatggagctgccccaaaagatgtgcaggaattgttgggacactcagatgtcagtaccacaatgaacgtctatgctcactccacaagagatgcgaaacgaaaatcagttcggcttcttgataaagtggtgggcaatgactaaaaaatttcccttatttcccttgtgattatctcataagggcaaaaataagggaaactacatatcatttcactaatggacaggcgggaaagcctataaaatggggaaagttagaggaataattatataaattccagattttctgcatcctccagcagttccagacgcaaggctgaacagaatgccggatgccactgcagcttttgggacttctcctgttgatttttcgtttgttctttttccaaatgttctccttatattatatgtggtttttgcttttatttcaacgcacaaaaattgcagactgttaaaccctgaccgtcaatctccgaccgtcaaaacctgactgttaaaacctgaccgtcaaaggcacattaaagttcacatctttcacttatacaacaaaacaaatgggatttctggcagaaactgccactgaaaaaagatatgtttaccatagcatatccccaccttcctagcaaggaaaactttacgtatactgcatatatgtaattgcaaaacgtattctacctgtgaccatcataaaaaagacacacaatgcgatactctctcacattgtgtgtcttttcttaaatccccatactaatcaagcaaaaacaaattctgggattccattttcacagtagtttttcccacccttggtgttccatccggatttttggacttattgttataaatttcaaaaacaatatccccttccttctttttgttttcccctgtcgtatcataaataaagtaatactcacccatatttttcaggttttcaaacacatattttttaggattccccttcgttgcttttccctcaatcaccgttccgtcttttttgtaaattttatctacgtaagttccatctttgtattggatcgaacaggtcagcttcgttctgacggtattcagttcgaccgggctgaagcggattttttccttagtgccgtcaaggttatttccatattctttcatccagttcatcttatacaccagattcggatcacttccatttccggactcctcttttaaaagctccgcctcttcattcagaatctcaaccattggtggctcatatgtggtacggtatgcggcaatcatcgtattaatgaaaagttttgcctccatatctccatctaccgtagaatgacctactccggaataaaaaacatttcccttactgtaaatatagtaattattggcggcatcattcggggaagccccataggtggcaccggttccatctccgtttgaagccgtacccgcccatgcacacggatctccgttctcattatccgaaagacagtaccagaccgtaacttccggatcttccatgtccagctgataccactgcccatgcgttgatgcaattttaagtgtttcgtcaattttaaacggatattccgtaatctgtcccgtattcgtcttcgttgcacgcattgtcaggtcattattattgttaaatcctgtcaatttcacattatcgttactcacgccacagatatattcatcatttttataacttctgatcatataccggtatgggattatttgatccgtatttttcttttcccatcccagacgtttcatggcatagtaagtaaatccctgggtattaccaagtgccgttgtagaaagtgtaccgttgctgccaacggttgtctgggtcattgtatcatacttatgtttcgcctgataagccagcagttcctttcgttcgctctcggtcagtttcccactcacagctttataccggttcattcccatgacatcacgcagatatgtattggcagaatatccgaaatccccactgtgcacattatgcatagaagtaaaatcatgcgtaaacaaaacactttttccagaggcgataaaatatttcaggaaatcaatcgcaccgtttttattcgacatattcaccttatggaacgtatcgccaaatcccagaataaacatattgtatgtatgatacagttccttttgtttttttgacattttagctggattttcgtttcccttttgggctgaaatatccctggaataatcatacacaaatttctccccgaaataattctcctgaaacttagaaaccgtagtcgttaccacggtaatattataatcattcaatgcattataatatttcgtaaacagcgtattttcgtgcaaattcagataccccttattattagtatccgtatccggcataatctgaagcaccttaatctcccgtttctgtccggtctggttttttgcaaccgagcagccggtacgtgtaaaatgaatgtccggattatccttgcggtatacaacaatcttccactggatcagcccgaagtacagtctggaaagttttaccggtgtaatgttctgttccccgtctcctgccgtaaaaacatctccctcataataaacttcccctgtatcatccgaatcatccgcatccccggagccatccacatctgccagcccctcttcaaatttaccatcctgattctggtcaatataaactttacactgatactgtgcggatggcacatccgtcacctgaaaaccaaaatcaagttttgatctgccaaaaccgtccacatccagataatttgcctgactgtcatctacggaaacagacgtatcatttttccccccagacgaagtcgttccctgatattcatttggcagttttgtaaacgtaattttcggacagacctcttttacctttgcaatcagcccattgctatctgacgtctggtaaatggttttcttttccttcttactctccctgaccagatctgcaaggtttgaaccggcatctattttatcggacaggcaatagagatcatcaaccgcaacaaccggataaccggcatgtaaaaagttctccagttccgctttcttaatctttgtaatgtcatttcccgagaaacggagtgtcgtatcctctataacattatttccgcttccagcccacaggaacttgaccgaacggcttatgccgtctgacctgctatactctgcactggtcattttatctccggtatggaaataaatttttccgttcatcgtggtatcattccacacagtctgcatctcatcaatccatttcacgttgccatctgcatctttgtaggctacacgttttttctccagattgtaagcaccctgatccaacccaagataaatcatgttgtacttgctgtttagatcctccgtggaaccaataaactctgccgtagtcatatgggtaatcttaatatccccgataaaattcggaatcataagctggatataactttttttcagcgagtacccgttctttcggtcatagcatggctcaatatccaatatccgcagttctccatccacatgatcctttgatgttttatatccgagaatataacggactgcatctgccggtgtcgctttgggatcatttcccgtaaattccttaaaatccgtaaacttagaattcggatccgatgccggaaccgtccccgtgccaaatgcctgtgtggaagttgtatcccctttaaacacaaacagtctgccatttaaatatccctgattttcattggtagaaatatttccggcagtcatatacttctcccatttatcctgcttcgtccagtaatggtaccagttctcgccgatcacacgtccatccacatcggacggaagaaatgtaaacatagaccagtatgtctgcgcatcgcccgtctgtgcagtaaacacaccagtctcaactccattaatttctttcttttgaatcaaggcatcttctccatccagatacaaccgctgaaacagttcagaatccatggaaaacagcatgactgccagtttatacatattattgttatagcccgtatcggtataagtataaatggttggattcatattccagtccagaatatgaaacgtaaccgattttcccccacttaaagatccctctgtatttatatacaccccggaatccataaaaatcggggcatagttttcctcctgattgatcttcttatacattttcgtaacaacatcccagctgatatctttcgatccattaaatccattcgtatacgaagaaacagacgaatgctttccgtacctgttgtgttttttccagatctctctgatattatcacccccggaatgtacctttggggaaatcacatacagatccgcataatctgcccattccggctgtgcattcagctcttccggtgtaatcgttttaataatcaccgaataattgtctgcttcctcctgtgttttacagccgatgctgtcctttaaaaaataatcattgtttttatatagatagtaattatttgttacattgatattatcctttgatttatcaccggtactttttctttttgtataaatccggtcgccctcattggtaagttcacgatccgtcttttcatcaaatgtctgatctttatcatccgatttttcgaaatcatttactgtatgccagataatatttccatgatcctgtctgacaaacgataagctttcatttccgtcttccccttttacgattttttggacaaacgtaccttccccatctttaacgcgctcatagtatccggtatattctgcatctttcatgccatcctcacagacacgcatatttccagaatattttgaaatgtccccttctggctcatccgggaaaaaataagccgttttcatttcacattttgcaccggttattgttttaaccgtattaatatcagcatccccataacgcatctcttccacatttaccggttcacatccactgatctggtatccaaactctgcgtattcttcataaggcacaatttcaagaatcagaaacgggttttccctggttccaagctttgccgctgcggcattcgcatcgtaaatgttgcgcttcgactccggaatctgctctatctggtcaacgactcctcttgtcatcaccggaagtttctcatccgcctttaatttattccggtacccgacaaccccaagacagacaacaagcacccccagcatacagactgcggatgcaattcttttattcctgtttccgttattttttttctgccgatgccatcttaccatcttcaatacgaacgccccttccttacctgagtacatttctcagcttgaattcattttgtatcgtatacttctgttccagatattgcatatcaaaagaaaccgcaacggatgccttttccgtggaagcatttactgtgccggtaaatgccgtaacatattcgccgatcagattttcctgcacctcatccgtagctgcagaaatcaccgttgtatcggtttttggatctgccacagccattttctttgtatataatttctttccacctgcagagatccagatcacccgcttgcttgcagcctccggggctgcggcacctgccggatttgttatcgaaggtgtccccggaatcttatatatgacgattccttctacaccggataccgaaggatcaagcttttccacccggtttccctccatcacccacataccaatctgttccatcagaatctgtgactccgactgtaaatcaatctgtgcggatgcatggttataatttttgtgcgccatccccagaaaaagaattgcagcgccaaaaataatcgttgaaattgcaatcgcaataatcagctccacaaacgtaattccactatgatcttttcgcacactgccactcctttccaaagttatttctcaataaaatgttttccggtatcacttaccagctttaccgtatatgccggtactccatcaatatagatggcacttacattcgtatttgccgtatcaaagcacgccgttttcgtgtaggcaatcttgatataatttccaccggcacctttttccgtcacctcattgcccgtgctgctgtccatccggattttgatggtattgttacacaaccgcgtaccgtcatccgtcagcttcgtatcatcaaaactgcttaaattatccggaagaatccgcatataatagccattgtccagtttataaacatacatatagtaatcaccggttttgctcatcgttttcacctgaagcgcactgagcgaagaatcaagggtctttaccaccttctgcgtgttggcataatgcagatgcccgatcatcatcaccgatgtactcgccagaattcccataattgcaatgacaataatgatttctaccaatgtaattccgttttgtcccagatgttttcgttttttcattggcacacctcttaattctttttccagttatcgtaattcagatacgaatccagatccagatttccggaaatattcgataccgccgttgaagaacagtcacggaaaaactgcgaaaacaaaggcgtatcccgtttctggtcttccgcgaacaattgcgataccagaagtttatttccctttatatgaccggttcccgcagcgcctgcattcgaatcaaacgaaatcaccccgccagaaataatcagtccctcaaaatcaccggacactttgacatccccggttgcaaccacaagtccccgcgtaaccgtatttggaagcgcataggtcccggtatttttcaccagatacacatctgtggttggtgaataaacggtcacactttcggtagtcgatgttttatgtttttccagttcctgttcgaatgctttccggtcaatcagtttgtcaaacagcggattgaccgttttatcaatcacttcatgaccactggcatctgtacttgtcagacgcacctgatccggcgtcacaccctgcccggaatcggtaagtcccagttctaaagacttatagcggaccgccaacttagaacaataatcccaaaacagaccgttaacgtctttccagttatccggctgaatcgtcaccttcttgacattcagggcatccgaagcagaagcacgcgaaagaatatctcccttcaacgtcataatggttttcttgtcaataatcaaagcattttcatccagatagagattggcatactgtgctacctttccctgattgttattgtaataatttgcaaagaaatcatttgcatcctgttccgtcttaaaattcaggtaataatacattccctccgggaaatagtatgccacaagcggctgactgctgtttagatacccttgtaacgtatcgtcagaaataccaatatgcgcagcatacccacttctgtcaaacgttccatttttgacatactctgccggcacataataagccagctgattggttctcgcagagatggattctcccattagaacatcctgattttttgcagcatctgtcttgcgggaaataaatgtacgtcccgccagcatcagataatttaaatctttgagattcaaattacacgttctgccatttaccatcatagcactgctgaaatccgcatccgaagataccgtatcggaagttccgtaatttttctggaaattataaccataataatttcctttcaaagtcaccttacttccaactccacgtaactcaagatcatctgccacatacgtatttccgttgatctccatcgtggaagatccgcttcccgaggtctttatattttccgcccagatcgaagaatttccgtttccgaccgtaagcgtagagccactgtccgtcacgatatcgccgcgtgtgagaatcgactttccctttaaagttccgcttccgctgctgtcggccaaaataccatccgctccggcgtacacacttccatccacctgcacattcgatgcatttacatgaatctgccggtccgcaatcagagcatatttcataaactcctggatctgtccctgcccggaaaaattcatctgcggagtagaaaaaataagatccgttgtgatctttgtctcataatcctgcgcatccttatatttcacctgcaccccttttaatgtaaaggtacccgcaccgtaatccagttcatacttcggatccgctgcaacaacataacatccctgttcggcagtttctttgatacatcctttgactgtatcggtgttataatccgaaaccgtatacacgacattgccggatgcatctgtcgtatttgtctttcccgcagatgcctttgcaaactgtccctccagatcttccatatattttcgggaaaaaacatcctgtgcatttgctcccgatgcggtatacgtcagataattttcaaggacatccgtatatgctttctcgagcgatttttctgcaagttctcttgcaccggtacgcagatcatccataactgcatctgcactgtagaaatttttcttcgtaccgcgctccacttctttcatctggatattgacaatcgtgatttttgtaatcacaaccgcgatcgcactcacaaccaccatcagaatcaaaacggcaagcagagaggctccgcgattatcccgtttcaaagaaatctttttcatcgctactctcctttcgccgaattcaccgtaatataccgatacgtttccttatcggagctgttgccttttccctttttgtatacactaacctgcagattcaccttccggacaccttctttgctctccaccaaaggtgcgacactcagcaaatagctatcctgatagatgtttcccgcattggttgttgccgccgggtcatccgggtacgatttgttgccaagattggacgcaaccgccggcatcttacagccgtctttcggtgacaccaccagctgataagagagatgctttgcgttgacctcactgatattctgacagacaacgatcagtttcggaaccgccactccagccgcacaacggatttcaagtgcatccctgtcctgcttgacattgtacatcagataaatgtgttcgatattctgcatgtcctcctctgcaaaatcattacaggtatagacttctgccgggtccactccatcgatattttcacaggcgtaactgcatgcgacaagcacatgcgtaggttccaccgtaatggaaatcgtccgctttaaatttttttctatttcactttcactctgtgccgggacattgtttgcacctgcatactgtgcattttctgcggaaaaataagtaagtgcttcctgtaactgtccaccttctgccgccacaacatcttttgtgtcatcaattccatccatttgaggcatcagcgctgtattttccggcacatccgtgctgactattacttcaacatcatatttttgaccaatcgcatctgccgcaccgtaataagatacttctccggcggtcgtacttcctcccgcagctgcaggggtatatcccgtctgcacataaccggtcagatacggcacggtaaatcccccggctgacacaggctccaccagttgcggctgtttttttaagtcctccatcacttcctgcgccagattggtcgcatgctgtttatctgccgtcattgcattgtatttcatcgactgcgtaaaatacgacaacagcggaatggaaagaatcgccagaatcgccatggcaagaatcacttccagcaaagaaaatcctccattattctgttgttttttcatccggaagcctccttccccatgtcagctttttctattgctctgcggttccagaagaagaaccgccaaaaatattgtttaccccttttggcatattctcaaataccggaggaacataatcttttccggtgttttcaagataatacatattgagtgtcatatcgcccgttaattttcccgtagaattgtcgaagctggcggaaaactgggcaatcgttgtacgatccttaaacttgttgacataggcaatcatatcctttaatccttcataacttgcctcatagcggatgccaatcgatgcataatacccttccacatttccggtcggacctgtcgtgttttccggtgtgctttcagtactctctgtgctctgtgtatccgcagactccgtggtctgtgtttcctgtgttgtcgttgtatcttccgtagtatccgtagatgcagcagcacttccgtctgcagcggctgtactgttatctgccccaatcggcatattcatggcaaatgtcacatctgtaatatgaaaattgctgctcttatcctcgaactcctgcaaagtttcaattactttttcggttttcatatctgccggataagccgcaataatatccttttgctttttctgcatcgtctggatattttcttttacttttggaagtccggcctccatctgttccatctgctgcactttcgcccgatcggtcgtattctgctcttcgatcttcgccgccttgctcattcccttattaaaaataaagaaataggaacatgctacaatcacaattgcaaagaaaatgagcaacagccgcttatctgaatctgaaatttttaatttattcatttgtctgctcctctccctctgcgttattggtatccgtgtctgtgtcctccgatgtcggaaccgcctcctcgatcagatgtccgtcctcaccgatatctgcctgggtgtaatagccatttaacgtgtatgtccatgtgctcacaccgctttcgtcgtctttttcctccgacatggatggaatggaaagatcctgaagcagggtcacatccgcaaaattcaaaagcatctgtccaacggcaatttctttatctgttttcagattgatactgactaagtctgcatctgtctgaatactctctaccttgacatcgtttggcagcgcattttccagctgctcaatcagcggatacaactgctcatttttcgtaacggtggcaagatccagcttctcatatacctgttcctctgcctgtacccgcgcataatcatcataggtttcctgcacatacgaaagatcattgatccgtttcgtcaaattgcgatgctgcgtatatgccaccagctgacgcacactcgatccaagaatcaacaatacactgactaataccgctcccacaaaaatgacataagccgtgtgaaggtcattctttttggaatctgccacaagcatgtccttcggtttggcatcaatcggatgcaccgccgcaccgatgacggacaaaaagccaacagccgttgcagccttcggtctgcgtccggaggacgctgtcgttatcccctcttcttcaaccgctttatttttttcactctttaaatcaattaccttagtgaaatcaatttcctgcaatggaagcggaagctcctgggcaaacagtttatgcatacccgcaaaccgggaaccgtcccctaccaggtagacatttcccacgaattcctgtttgatctgattctggtaatattcaaccgccgtattggcaattcgcagatgataccgcagcgattccgccagatcttcatatgcctcatttgccagctcctgctgacgcttcatctcctcctggtttcccatctccggaacggtcgggcgattgtatatgacattgtggtctaaaagaaaatcaagtgctttctcctcatcatcaatcccaagcaccggatggtcgatcaccatcgtgatcgtggctccatagccatacggtgtcacacgctgaaagaccagttttttattttccagaatactgatgaccgttgcctgctcttccagctgcacaaccacagcattttccagaaaactgtcacacagaagctgtaccgttccgtttccgatataatcaaacgtttctaccttcagtcctgccagttctgagaacgtcacatagttattcagaagattatcgggaattgccactaaaagcagcttgagcattttcttcccatcttcttcctccacatccatcttgctgtagctgatggtgtaattgctcacatccatcgggaaataatcacggatctgggattcaatgattcccataatcttattgtctttgacaaatgggatcatgacttcacgggtcacgacttttgaggaagaaagggtaaatacgacttctttctcatggatatcgcgcttgctgagttcgactttcagtgcagacgcaaaagcttccttgtcacggatatagccatcttccaccgcatgttccggagtacggaacgcaaaggctttatgtaccggcggatttttcttgcggtaatcggccagtgcgacttttgtccaccatacaccggcctcaatacttactactcttttgaccattttcattttctcctttatattttccgaaaggttttcattggaaaatgtacaaaaataattatgctttgttcatgttctctgaaaaatcacaaatcctaattatttttctacattttccatcgtaacgttgtggcataaaaaattgtgcggtgaaaatgacagatgtttaaaattcgccacaggaataagaaaaactttactttttttaattatgccatacgtagcagttcatgccacgttttaataaatgcccatcatgccgagataccaggtccagaaacggctgccccagagtgcggcgatgaatatgcctgccgaaaggtacggaccgagtgcaagcaggttgtttcgcttgcttactttcatgcggatggtatggatgacggatccaagaatgcatgcaagaataaatgcaaaaataatgttttttgcgcctaaaagcaggcctgcatatgccatgagtttgatgtctcccccaccgattgctttgccggaggagaaataatacaggccatacaaaaacaggctgacaatgactgccccgatgatatgggacaggatatgccggaaatcatacacggtcatgatgataccgagcagtcccagaaacaggttctgggaaaccggtatctgataggttctctcatcgatgaccgcaatgacaatcagggcagatgtcatgaggcaatacagcacactgctgaacgtgaaaccgcccgccatgaaaacgaccacatacagcacaccatttaaagcctcgattaatgggtactgtatggaaatcctagcaccacattgccggcatctgccccgaagaattatgtaggaaaatacaggaaccatgtcccgccagcccagcttacgcccgcagttcatacagtgcgaggactgcacgatattctcttttttcgggatacggaagatcagcacatttaagaaactgccgatgacgattccgtataaaaatataacaatataaagaaaaatcgtaagttgggttagcatgctaaaaacgctcctaaaatcgttcgaattataatgttgcctttacatcagcaactttttcctttggtgtacttgcatctgaatacttaattgaggtagtaacattatgaccatcaatatcaaatttaataataatatcatctgtcatagtctttgcatctgatgcaaactgtttttttacattggctaatccattagttccatcatatcccgtatttttctgaattgcagctgccaatgttgctgctgggctatctgcagtatttgttccatatacgttaactgttatagttcctgtggttggcatagtttctgcattttccgcatatgcagttactgccgctgaagaaaagctatttaaaacctgctgatccttagatactttagatttattgatataaggaattacctgtgtaccaacaatacctaccaaaattgccataattgcgataacgataatcaactctacgagagagaaacctttgttatccttcttttcattctttgccttcatgttctgaagcagttccataattttcttcataccctttgttctccttttactaaatatgttttttatgtatctatcatcacatgtctcatggcagacatgtaacaacccttcttctgcctgcggtcaggctccgatgctgtcgtacagactgtacatcggcatcatgatcgcaaggacgatcggcaccacaataactgccatcacaatgatgatgagcggttccattgcggcaagcagtgcctcggtcgccgactccacctcttcatcataatatgctgcgactttgtcgagcatgtcttccatattaccggtttcctccccgatctctatcatatggtagaccatcggtggaaagaccccggaatctgccagcggcttcgagagcgggattccacggctgacctcttcggtcgcatcttttaatgcctgcttaaccacggcattccccatcatctcggtcacaagcccgagtgcatccaccagctggacaccggagcccatcagtgtggacagtgttcgcgtcatgcgcgaggatgccgtcttgatgctgagcgggccgaccagcggtacctttagaataaattttcccaatatatgtgccccactctctgtctttttccacgcatggataaatatggcaatccctgcgatgatggcaacaataaaataccagctgtgcacaaagaaatcactgactgccatgactgcaagcgtgatgcccggcagttttccgccgacttcgtcaaactgggaagtaaaggtaggcacaatcttaatcatcatgatggctacaacaacgataataacaagaatcaggatgaccggataaatcgccgacttgatgatcagccccttcaggtgggcttctttttcaaactgacttcccacacggctgaatgctttatccagtccaccggaggattcccctgcggcaaccatctgcaccatgaggttcggaaaaatcttcgggtgctccgccatcgcaacggcgagggtctccccgcgctgtacggaatcccgcacttctgcgattgcgttggcaaacggtttgttctcggtctgctcggatagcatgtcgagtgcctcgacgacggtcacgccggcatttaatacgctctcaaactggcggcagaatacgctcatttcgcggacgctgacggcttttccgatatggatttcgagatctttgttaaatgcgttggctcttgcgatggaaacgatggtgttgccgccggatttgagttctgccgaagcgacttccatgttcatggcctcgatggtgccggtttttggttttccatcggctccgaccacttcgtatttataacttgccatgtcttaactcctttttaaaacagcttctgctgcatgtttcctgtatcctgtgcatactctacggcatttgccgcatcgattttgtgtttcagatacaggctgaataaggaatcatccatcgtctgcatgccaatcttcttacttgtctgcatgatggatggaatctggtgtgccttatcctcccggatcaggtttttgatcgccggggtaccgagcatgacttcaaatgccgccacacgggattttccgtcgatcgtcggcagaagctgctgcgaaataacagcttccaaaaccgatgccagctgggaacggatctgattctgctgatgcggtggaaacacatcaacaatacgctcgatcgttggtgccgcaccaatggtatgcaatgtggaaaataccagatgtccggtctctgccgccgtaatcgcggtggaaatcgtatcaaaatctctcatctctcccacaaggataatatccgggtcctcacggagtgctgcacgaagcgcatttccataggaatccgtatcaaggccaatttctctttggtttacaattgaccgattgtgtttatgtaaatactcaattggatcttccaatgtaatgatatgttcattccgttctttgtttatgacatcaatcaaagaggccagcgtggttgatttaccacttcctgttggtcccgtcacaagaaccagccctctctttttctttgtcaatccaagcacagcttccggaataccgagtgcttccggtgttggaatatcacttgccacaatacgaagaactgcagcatacgaccccctctggtgaaatgcattgacacggaatcgccccacacgggtatcggtataggcaaaatccacttcaccagtggcctccatggttgccttctgtttcggtccaaacatggattccaccagttctttggtcatcgccggtgtcagtttctcaaatccgtccatttcataaagtgttccgctgatcctgcacttcggccgtacccccacggtaatatgtaagtcggacgcatgatgcgcttttgctatcgaaagaagcgtatacattgacaattccatctgttttgctgccttcccttccctgttttatttaatcctcttcgtcatcgtatgccacacgctgcacttcctcgacggtggtgattccgcgcagtgcgtaatcaatggcactcatgcgaagcgttttcatgccatgtgtgagtgcgatctcctcaagcacatccgcattctccccgcggttgatcgcctgccgcaggtctgccgtgaccggcatgatctcataaataccgattcttccatagtatccggttccgccgcagcggacacattctttgtgccccggtgtgcggacattgatccgtctggcgggatcctttatgccgagtatttttttctctcctgcggttgcctcccggacaattccgcatgccggacagacccggcgcaccagacgctgggcgattaccccgaccacggaatccgcaatcaggtagttttccactcccatatctgccagacgggtgatggtatttgccgaactgtttgtatgtaaggtgctgaccaccaagtgtccggtgatggatgcctttaccgcaatctctgcggtctcctggtcacggatctccccgatcatgatgatgtccggatcctgacgcaggatggaacgcagtgccgaggaaaaggtaagtcccgccttttcgtttacctgtacctggttgaccccgtttaagttcgcctcaaccggatcttctaccgtgatgatattgacaccttctacgtttaattcatttaatgcagtatataatgtcgtggacttaccgcttccggtcggtcccgtgacgagaataagcccgttcggatggcttaggatgtggtcaaatttttttaattcgtcctccgggaatcccagatcccgcttgtccaatgtcagtgcttttttctgtgcgagacgcataacgaccttttccccatagacggtcggaagcacggacacacggatgtcgtattcctgccggtccacaatgctggtcgcacgaccgtcctgcgggcggcgcttttcggaaatgtcaagtccgctgacaattttgattcttgcgatcagtgcggcatgcaggctgatgtcgtgccgcatggcttcgtgcagcacgccatccacacggaaccggatccgcacctggttttccatcggctcgatatggatatcgctggctctcctgtggaccgcctgctcgatgatctgtcctaacagtttgacaatcggtgcctgctggacattgttctcatcgtttccactcccgggatctagggctgccctggcttttgcctgttcctgcttttcccttgtatactgttctgccacacgcagggcttctgcatttccatagtagcggtcgatggctgccgcaatatcactcggggttgcagcaaaacgctccacctgacacccggtaatgatggaaacatcgtccatcgcccggatatccagcggatcgctcattgccacgcacaaaagattgggatttttctcattgaacttaaacggaatcagattatacttccgcagcactgcctcgtccaaaagccggatgatttcctccgggatgcgcagggttgacagatcgacactctgtattttcagctgtgccttcagtgcctctacgatctgtttttcgtctgtaaaccccagatctatcagtaccactccgagacgctctccctgtttttctgttttctggacctgtaacgcttttaccagctgatcctgcgaaatgactcctgcatccacaagcagatcgcccagtcgcttcttccgggcaaaccctaccaacttatccatgtaatactcccactacgttaaacatttattattttcgaataatttcgagcaattaatgattattataaccttttttgttctctattgcaatcctttttcatgtataaaatataactttattgcattttaccgtttctttttttgtgcaaatttcacatctaggtcttttgtcctattttatttgccgtcatttcctccacaaaaatgccatatcctttcgttggatcgttaacaagcacatgggtcacggcaccgatcagttttccgtcctgcaggatcgggcttccggacagtccctgcacgattccgccggtcagcttcagcagattctcatcctccacatgaaaacgaattcccttatttttatctcccggtgtataatcaagatcatcaattacgatgcgatatgactgcagttccccggacgcatccgacagaattaccgcatcctttgtctgaatctcctgtttgtaaccgaccggacacaacagactttcgtttttcttttcttcccggaagtttttcgtcaacgtgccatagataccgatttgtgtattgctggacacttctccgatctggttgtctttcccataatagacaactccctccagctctcccggtgttccccggacaccttttttgataccgagcacctgtgctttgtacagccggccgtctgacagacggagcaggtctttggtctgtccgtttccgattccgtgtcccagtgccccgaagtttccgtcctgatcaaaataggtcagcgtgccgatccctgccatgtcatctttcacccagagtcccagacgatagcctttgtgttctgctgcctcaaccggctccaccgatacctgaatctgctcggctccgcgccacagggtcagcaccaccggttgttccccgtactgattgatccgctccatcagttcttcttttttcgtgaccgcttttccatttacagcagtaatataatcccccggaaatacaatgtgttctgccggctgccggctgcttccgtccacagtttccaccggtccggatcccagcaccagtactccctgggcagccccgtaaatgcccaccacctgtccgctcacgtataaagattttccgttcaccacggaaacctgcacctctttcatgggaaggatgccaaacagatagcaggtcagtgtatattccccctgcttcagctggctgcacgtttccactacccgttcctgcttcattgcctgaaacgtccgctccccgatctgtgccataacggattgcggttttgtggacattgccagtgtgaccggaatttttttgtccagttccagtttctgcccctcctgcacgtatacatgatcgggaatggcatgtatcatggtggcataggcaaagcagcacagcgccagaacataaatacagataatatttttgaatatacgcatataaaaagaccgcatgccaaaggttctcctatcttctcggatacctttagtatgcggactttggttttatctattcgtatttttctgccagacgtttcatctcgcgtgcgttttgtaaaaccgtatccgtgatctccacgccgccaagcatccgcgccagttcctcgatactttcctcttcccgcagcggatgaatccgggaaaccgtggacgcatgctccaccgatttttcaatcaggaaatgggcatctgccatggcagcaatctgcggcagatgagtgatgcagatgatctggtgcgtctttgccagcagtttcatcttctgcgataccatctgtgccgtacgcccgctgattccactgtcaatctcatcaaagatcaacgtcggaatctcatccgtatccgccatgacggtcttgaccgctaaggcaatacgggaaagttctccgccggaagcgacctttcccagaggctttaacggttctcccggattggtggagatcataaattctgcctcatcccagcctccggcactgtactccgtcttccggaattccatcgtaaactgcacatctaaaaaattcagatcttcaagtgcctgtgcaatcgctttcgtcaatccctttgccgctttcttccggattccggaaacctctgcacacagcccgtccaattcttctttcttccggttcatggaagttaaaagatcatttaagtatttatcataatcctgtaatacggcaatacgctttgttttttcttccgctgactgcagaatctcttccatcgtatttccatacttggatttcaggtgattgatctcatcaagcctcttttcggtctgataaaagacttcgtcatcaaattcctcccccgacaggtaggaagaaatctcatgattgaaatcgctcagcagattatcaatatcggtaagcatctgttccatctgcgcaatgcgctcctcatatgccgaaaccgaactgacttcccgcagggcacggctgataagttccgatgcattctctccggtaccgccgtctcccccggtagctgcaccggcagccgatatggcatccatgatcttttttgcgtttgcaaatctgcgatactgttcttccagccgggtatcctccccgacggaaagctgtgcctcttcgatttccttgacttcatacgcaagaaacgacaactctctggcgcgctcctcggtatccaaagacgaggactcccactcttttttcagtttccggtattcctgataacaggcggcaagacgctcttttttttctcccagcgcgtcttttgcataggcatcgaggatttccagatgtttctttttggaaagaagggactggtgctcatgctgtccgtgaatatcgatgagcagagacgccacctcttttaaccgggaagcagacactgcttctccattgatccgcgcaattgcccttccggaagttatcttacgacttaatattactgtttcatcctctgtttctatgcccagttgccggatcgcatccagaacctttgggttttcaaccgaaaagaccagctccacaagtgcggtctcttcgttatcccgaagcagttcctttggaaccttctctccgagtgccagtgcaaccgaaccaatgatgatggatttaccggcaccggtctctcctgtcaaaatattaagtccttctttaaattctacctctgtctctgtaataagagcgaggttcttcacatgtagattttgtaacatacattctccttctacttttccgaagcatttttattactattctacaattttccgaagctttttcatgatgtgcaccgcgtcatcggacgtacggatcacacacagaatcgtgtcgtctcccgcaagtgagccgacaatctcctgcatacgcatggcatctactgcagccgcaacggctcccgccataccggacacggttttgatcacaacaatattttccgcagcatccacggacaaaaatccttccctgagaacccttgcatatttttccatcatattggaatccgcgtccgtaatcaccgcatatttttgtctgccgttgtcggtcgaaatctttgtcagcttcagttcacggatatcacgggatacggttgcctgggtaacctgaaacccttctttttcgagatatgcggacaattcttcctgtgtttccacatcttttttctgaatcaattcgagtatctttgcctgtcgtgttgttttcatatgtcctcctttgcgtcctacggtctcatctttttcctcagtatttccaggaaactctggttactgattttgcagatccagatggtactttgtgcctgtgcaatccgcacacggtctcccacgtgcagatgctccggtgtgtccccgtcaaagctgacacatgccgtctcgtccttttgaaaccgtctgcttcccatcttaatctccacaacatcctccgctccaaacacaatgcttttggagtttaagtcatgtgcattgatcggtgtcagaagaagtacccttgctttcgggtccacgatcggacctccggtggaaagattataccccgtggaaccggtcggtgtcgcaacgatcacgccatctgcgtggtaagttgtcagatattccccattgacatacacatttaaaagcagcatggacagatccccggaccagtggatcacgacatcattcaatgccatatgtgcgccgtttccgccaattttttcgccggtcagaacaatccgctcttccatgatgcaatcatcctgcatcagacagtcgatggcatgaaatacggtagcttcctcaagctcacacagataccccagtgtccccaggttgacgccgatcagcggaatctgcagcgcctccaccttggttgctgcgcggattaacgtgccgtctccgccgagaacaaggatacattccgtgtctgccggaatctcggaaagtgcaaaatctttctggttatcatcctccacattgctgacacagattgcagcactgccgcccttttgttgtatgtacgagacaatttcgtttgagagtgtcagatcacgatctttgtaccggttcgtgatcagcataaatttacgcatctacttatccaattctccgtgtgctgcttccacaactgcgtgaatatccacggattcctcctttattgcttcgtccgatttttcaatatgcacgagatactcgatgtttccctccggtcccttgatcggtgagtattccagatggtgtaccgaaaatccgttttccagtgcaaaggtaatgatcctctcgatcacttcctcgtgaacggccttatcacgtaccacgcctttctttcccactttttcccgtccggcttcaaactgtggtttgatcagacataccatctgtccgccgtcctttaacagtgcatatgccgccgggagcactttggtcagggaaataaatgagacatccaccgaagcaaaatcgagcacatcatcgatatcttccggtgtgacatagcggatgtttgttttttccatacagacaacccttgggtcctggcgcagtttccatgcaaactggccatatcccacatcaacggaatacactttctttgccccgttttgcagcatgcagtcggtaaacccgcccgtcgaagcaccgatgtccatgcacaccatgccatctaaggaaatggaaaaatgtgtcatcgctttttccagtttcagaccgccgcggctgacatatttcaatgtatttccgtggatctcaatcggagcatcctctgcaaaagtgcttcccgccttatcctcccggttattgttgacaaatacattgccttccataatcatggtctttgccttttcccgcgatggtgccagaccacgttttacaagaagtacatccaatcgttctttcataattcctccggtaattctgctaatattttttccgtcacggaatctgcatccagtcccagtgctttttttaattcgccaacacttccatgttccacaaagcagtcaggaattgcaatcctgaggacctttgtatgcagtgcttcctcctccagaaatgcagccacatgctctccaaatcccccgcttgccacgttctcttccatcgtcacaagaagcggatgggattctgccagtttccgcaggcagtttttatccagtggcatggcaaatcttgcatttaccaccgttgtcgggattcctttttctgccagtttttttcttacctgccaggcggtttccaccatcgaaccgatcgcaaaaagtgcaacctctgtaccctcggcgagtacttccgcacagcctttttgaatcggtgcccgctgatctttccagagatcgcaggcttctccgcgcggataacggatcgccaccggttcctctgcagcaatcgcatacttgagcatatcggaaagctcccatttgtttttcggagccataaccgtcaggttcggaatacttgacagatacgacaggtcaaaaattccctgatgcgtggcgccatcctttccgactaatcctgcacggtctacggcaaacacaaccgcaaggttttgtgcacacacatcatgcagcacctggtcataggcacgctgtaaaaaggaagaatacaccgcaaataccggtttgagtcccgcctttgccatgccggctgcaaacgtcactgcatgctcctcggcaattcccacatcaaaaaaacgttccgggaaaagatttttaaatctctttaaaccggttccgtctgccatcgctgcggtaatcgcaaccaccttcggctcccgctcccccattttgcgcatgacggtggaaaacacatccgtgtaatgcgctttttcctgatgatacagcggaacaccggtgtcaatgtcaaacggtcccgttccatggaagcgcgccggatgacgctcggcaggaagatatccctctcccttgatcgtgcgtacatgaaccagcaccggaccgcgcacacgctttgcttccgcaagcacttttcggatttcttttatgttggtgccatccaccgggcctaaataggtgattcccatattttcaaaaaacattcccggaacaaacagctgtttgataccgcttttggcgttccggatccgtttgaccatccgttcccccacaaccggaatccggtttagggaattggtcacaccgtcttttaaatccagataggcatccgaggtgcggaaggaattcagatactggttcattcctcccacattttcggagatcgacatctggttatcatttaacacaataataaaattggttttcatgcgggaggcattgttcattgcttcgtatgccataccgccggtcagtgccccgtctccgatcacagagaccacataataattgtcaccggtcagttcccttgcctgcgccatgccaagtcctgcggaaatagacgtggagctgtgcccggtattgaatgcatccgccgggtcttcctgcgtctttgggaatccgctcatcccgccatactgccgtaaagtggcaaaccccaacttacgcccggttaaaatcttgtgcgtgtaggactgatgtccgacatcccagataatccggtctctcgtcaggtcaaatgacagatgaagcgccatcgtcagttcaatcacacccagattcgatgccagatgtcctccggtttttgcaatattttccaccagaaaatcacgaatttcttcctgtagctctgccagttcttcctcgtttagttgtttgatatcatttactttttttatccgatctaaaaccatgttgccctcgaaaaattaatgatccctgttgatcaaatagaaaaacaggtcatgcagaaacgtatgctctccttcaaattcatccagtatctttattgcttccccggaaagccgctctacatccttttttgcctgctccagcccctcaaatgtcacataggttgccttctcattttccgcatcactgccgatcggcttaccgagtttttcaaaagatcccgtgacatcgagaatatcatcctgtatctgaaaggcaagtcccagctttgctccagcttcctgcatacgcgcaaccgacacttcatccgcgcctgccaaaatggctccgatcataagcgatgcttcaatcagcgctccggtttttaaccggtagataaagtccagccggttgcggtcgatggtctgtccggttttctcactctccacatccaccacctggccgccgatcattccgtatatacccgctttttgtgacagcacggaaaaagccctgacaattctccagtctccttcgtttctggtcagtgctgctgccacggtctcaaacgcataatttaaaagcgcatcccccgcaagaattgccattgcttccccgtataccgcgtgggttgtctttttcccacgccggtattcgtcgttatccatcgccggaagatcatcatggatcagtgaataggtgtggatcatctcaatcgccgccataaaatcatcaattgccggattcgttccgtcaaacatctggtaagatgcttccatcagcatcggccgcagacgctttccgcctgcaaaaacactgtattccatggcatcgagcacggtctgctgaaaccccttttcctgtggcagaaacggtgcgatccgtgcttcaatgtctgccgccctgcgttttatttcctgtctgatctccatcagaattcctccaattttccatcctggttcagtacaagcattgccttttctatcgtatccaaagactggccggctgctttgatctgttccagtccctctttgtatagggcaaacgaacggtctaacgttacgttttcgtcttccatcgcatcaagtatggcatcgatctttgcaaaccgttcctccagtcccggttcttttttttctaattcatcactcattttttactccttcggctgcctgaatttctgtcactgctgccgtcagtgtgccatccagcaaatggatctgcacggtatcttttttcctgatctggtggatgctccgcagtgcctgatggtttccatcctccacgaatgcatacccgccactgagtttctttaccggagaataactctccagcgtgcctgccagaagtgccaggcggtgtctgcgctcacgcagcagttcctccatgcgtccggtcagtttctcttcatactctgccactcttcgccggttttcattcatccgctgctgagggctgagatagtgcaggcgcatcctctggtgctccagatggtttcttgccacggttactttcctttggagttctttgtccatctgctgccgcatgccaagcagttcctgcattgcctgccgataatcaaacaccgccagctccgctgctgcagacggagtcggtgcccgcaggtctgcgacataatctgcaatcgtaaagtccgtctgatgaccgacagcggagatcaccggaatccggcagtcaaaaatggcccgtgccaccatttcttcgttaaatgcccacagatcctctatcgatccaccgccccgtccgacaatgattacatccacgccgatctgttcaagtgcatgaattccatggacaattgatgctgccgcaccctctccctgcaccagggccgggcagagaatcagctgcacatacgggttcctgcgccctgcaatattgcggatatcctgaatcgctgccccggtctctgccgtaacaatccccacggtttttgcataggtaggaatgggctgtttgtattcctccgcaaacattcccatctcttcaagctcccgctttaacgcttcaaatttcagatacagatttccctctccgtcccgttcaatcgtccgtgcatagatctggtatctgccatctctttcatacacttccacggaaccggtcacaaccacgcggtcgccctctttcatctggaattttaatccttccctgcggtttcccgcaaacatgatcgcgtttatcgttccgtctgcatctttcattgtaaaataaatatgcccgctggagtgatacttacagttagatacctctcccttgatgctgatatggtgcagcataaagtcctgagcgaacatatttttaatgtatttatttacctgccctaccgaatatacatgtttcatcattctgcaaactttgcaagaattccattgacaaatgccggtgaatcattggttccgtattgttttgccagttccacagcctcattgaccgcaaccttaaacggaatctcatcatcgtagcggatctcatataccgccagacggatcagtgccagatctactttgcccatacgggttgtcttccagccttttgcgacttcgttgattgcctcgtcaatttccgtcagatgattgtagatatcacgataacgatcagcgatatatttgaaatcctgatccgttacatgatccacttcctcgccaaacaataccagctgttctgacaattctcccgcatcaaaaaattctacgcggaaaagcatcttaaatacattttctcttaactctcttcttgtcatcttctctcctcgctcaaaaataaaggatgtctttcgttcagacatcctttattataccatattctgtttcgaatacaaagatttaattgtcagttcccatatcaacacttgcgatacggacattgacaacagcgactgtcagacctgtcatattctcaatggcagcctttactttatcctgtaccttggcagagacatccgggatgctgtaaccatatgcaatattgatggcaacatcaacctttacttcattgtccataatttcaatcatgattcccttagaaaggttcttcatgccaagcttgctgacaatttcgtttgtgatgtttcccgccatggaactgacgccatctacttctgttgctgcaagtcctgcaatgatcgcaacgacttcatctgcgatacggacatccccgacaggatctgattttatctgaactgtttttctgctatcagccataatacaattgcctcctcagtattttatctttgcttattataacagactctgtattatttggaaagcataaaattatacgacctgccccttggatacatatacctgatacgactcatttccggtcagtgacttgccctctgtgacacgtacattcttgtcggtaatcacgtattccacgcttgcattatcttccactacggtatcctgcatcagtacacagtttttcacttttgcgccttttccgacgtgaacgcctcgaaacaggacgctgttttcgacttctccctcgatcacacagccatcggcaaccataacattctttgctttggaaccgttgatataacgggtcgggttatcgtcacggatcttggtgtaaatctgatttggagaaaacagtgcatttaagttttcttcctgtaacagacgcatattttcttcaaaataactctgggtatcatggatattgaccacatagccatcgtagcagaacccgcggatatccagccggtcaatctgcttgtccaaaaggtcacgtacaaagtaagtatgcccatgtacatacgcatcatctatcatattgatcaaaaactcgcgttctaccacataaatattcatgctgaaattcatctccccctcttcggtcgggttgatgtaaatcttgctgacgcggtctccgttcatgccgagtgcatagtacagatccatgcgatccctgctctgacggataaatgccttcggaatttcctgcttgcggtacatcatggtcacatccgcaccactcttgatatgcgcatctaaaagttcattaaaatcaaaattgatggcaatatttgcatcggtcataatgacatatttctgtggctgctttaacagatatccgcgcagactctcaagtgcctcgatgcgtccctcgaatacctttacctgtttctgtgcgaacggaggaacaatattcaggcctccatttttgcggaccagatcccactcacggccggcgccgagatgatccagcagggaatggtaattttttcttacgataatggaaatattgtcaattccgctgtgtaccatgctggaaagaataaaatcgcacatgcggtatctgctggcaaatggaatggatgccatgaggcgctccgaaaccagatccggcaccattgcatcatagctgttcgggaaaataattcccaatgcctctgtctttgaatttaacattgctcctcaccctccttcacatcttcataaatcatagcgctcggaccaatttttgctccttttccgatcgttacatccgttgcaattgtggcaacttctccaattccttccccttttggttttgctcccacaaccgcatcttcttcgatggtcgcattttctgcaatgatacagtgtctgacaaccgcacctgccttgatcgtggagtgtcccatgacaacggcatcttctacaatggcgccttcttccaccgtgacaccagaaaacaggatggaatgtctgacggtacccttgatgttacatccatcggtaatcagacagttatccagcacagcattctctccgatccggtgacctgtcataccactgtttctgctgtaaattttccagttttcatcaaacaggttgatgccgctatgttccggatcaagcacttccatgtttgcttcccacagagacggaatcgttcctacatccttccagtatccgttgaaatgataggcatacatctttcttccgtcacgcagaagatttggaatgatattgtttccaaaatcattctcggaagtcgggtcagcctcatcctcgatcagatatttctttaaaatatcccagttaaatatgtaaattcccatggatgcaagattggacttcggttcctttggcttctcctggaactcggtaatcttgtcatcctcgtctgctaccatcaggccgaaacgggaagcatcctcccacggcacttccatgactgcgacagaaaattctgcccctttctgcttgtggaactcaaggaaatcactgtaatcctgtttgcagatctggtctccggaaagaataatcacatactgcggatcatagcgctcaataaaagcaatattctgataaatagcatttgccgtacccttgtaccagtcagaccccgatgctttctggtacggtggaagtacatgcacgcctccgtaaagacgatccagatcccacggctggccatttccaatatactcgtttaatacaaacggctgatactgggtcaaaatacccaccgtatcaattcctgaatttacgcagttcgacagtggaaaatcaatgatacggtactttcccccaaacggaactgcaggctttgcaagcttctgtgtcagtgcatataatctggacccctggcctccggcaagcaacatcgcaactagttcttttgccatataagtatcccccttctgttcataataattgcacttattatggtaacataaaagggggataattcctagtacttttggctcttttcgtttattttagtgcaaagttttctgtgccgtatacagtttgtaatatctgcctttctttttcatcagttcttcatgcgttcccgcctctgcgattcctccgtcatcaatatacatgatcttgtcacagccacggatcgtggagagccggtgcgcaataatgaaggatgtcctgcccttaagcatacggtttaatccggtctgcaatgctttttccgtctgcacatcaatgctggaagttgcctcatccaaaatcagaattgccgggtcacaaagcagtgttctcgcaaaagaaatcagctgtttctgtccctgggaaagcatggacccacgctcccgcacctgtgtttcatatcctttcggcatttcccggataaacggatcggcacagacaatttttcccgctttttcaatttcctcctgtgtggcatccaattttccgtaccggatattatctgcaattgttcccgaaaaaataaaactgtcctgcatcataatccccatctgcgcacggagagaatgaatggtcacatctgcgatatcctgatcatcgatcagtacctttccttcattgacattataaaaccgtgaaatcagattgacgatggtactctttccggccccggtcggtcctacaagtgcaacactctccccgggatttaccgtaaaggatacgtcttttaatatcgtttttgtctcatcatatgcaaaggtcacatggtcaaacgtaactttcccccggatctttggcatcttgatcgcatgctctgcatcttttacggtaaccggctcatcgatggtttcaaagatccgttccagataagcgatattattgataaaattgttgaatatatttccaaggttcatgatcggctgccagaaatacgaagcataactagaaatcgccacgatcgttcccagcgacttatttccctgcccgaaaatgacaaggccaaacaaaaagatggcagcacggacaaacaccgaaatggtatcaatgcccggccatacaaggtttgagtagcgcacagcggtattccaggtccgtctgcattctttggaaagtccgttaaagatttttgcattttcatcctcacgtgcaaaaatctgtgtaatccgggcacctacaatattttcctgcagatacgcatttaagtttgagttcttgttggatacggcctgccacgcctttctctgcttatttttgatccagaacataaagacggcaagcacgggaactccacacaacacgaccagtgccatctgcacatctaccataaacataaaaataataataaacagcagattaaatgcttccagcacgatattgatcagtccgtttgacaacatatccgataccgaattgacataattgaccacccggatcagaatctttccatgcggtctgtcgtcgtaatactgaaacggaagttcctgcagatgttcaaacaggtccttgcggatatcataaataatattctgactgacatccaccatgatgcggctgcggatcgtggtaaaaatcacgctgaccacatagatggcaatcagcgccgccaccagggaaaataacagtctcatatttttatcaggcaccgcaatatcaagtgcccgctgaataatcatcggtgccacgtacccgaacgctcctccgattccgctgaggacgatcgcaaggatcatacccctgcgatattttttgatataagatgacgcccggagcagatgccggatatcaaacggttcttccaggatttcatcctgcttatatgtattctttgccattgtctcaccccctataccaggtcttcgccggtctgcagctgtaccagttcgtaataatatcctttttttgccataagttcctcatgatttcccatctccgtgatccgtccatgctgcatcaccagaatctgatccgccatcatcgtagtggaaatccgctgtgcgataattaccttcgtacacgaaaaatccagatgccgcagtgcttcctgaatctgtttttccgtttccatatccaccgcagaggtcgtatcgtccagaatcagaatcgaaggccgcaccgccagtgctcttgccagggaaattcgctgtttctgtccaccggaaaggcctacgccacgctctccgaccaccgtatcatatccttccggcatctttgagataaaatcagatgccgcagaatattttgcaaatttttccacttcttcgagatcaatgctgctgtctccgtaggcaatgttgccctcgatcgtatcggaatacaacagcacatcctgtgtggcaagtccgatctgtttgcgcaggtcggacagtctgaaattctgcaccggtatatcatcgatccgcacttcccctttcgtcggctcataaaaccgcgggatcaggttgatcagggaagtctttccgcagccggtttctcccataattgcaatggtctcccccggttttacggtaaaagagatatcatgcagcaccggaagatccccatcttcatactgaaaggatacctcccggaattcgattttcccgtcaaagcggtccgggtgtgcagctgcatccaaagcatctttgatctgtggttcggaataatagatctccatcacctttttggatgcggccgagaaccgctgaaattcattcatgatatttcccatctggcgcattgggttggcaattgcccagatcagtccggaaaatgccacataatctcccatcgtcagttcgccccgaattaaaaagacaccgcccacggccagcatcactaccggcataaggtttgcaatgctttccacatatgggaaaaatttcagccataccatgctggtttctttgttcgtctctgcataatctttgtttgcccggtcaaatttttcaatttcatatgcttccctggcaaacgcttttaccacacggtttccggaaatattttcctgcgcataggtgttcatctgtgccagtttttcacgcagtttcgcatgcatcggtgccaccttgtttttgaacagataaatgataaaaaacacaaacggcgaaataattaacaggctcagagccattttccagttcatataaaagaagtatattgccaccacaccaaacagggaaaatgattcgatcaccatgcggatcacccatgcaaccatgtggcgcaccgcatccagatcgcccgtaacacgcgtcatcagatcgccggtacgatatgtgctgtaaaaggtcatatcctgcctctggattttgtcatacaaaaaattgcgcacacggtacagtaccgtctgtgacacatgctcgtaaatcatgcagtctccatagacaatcacaccgcgaagtacggtaaatacaatcatcaggatgagcagatgatagaacaaaccgctattcgttctcatatttttccacgcatctgccccgcttaaaaacagatccacaattcttccggaataatacggaaccgtcagttgcaatatattatagacaacggttcccagcatgccgatcacatataatacacgtctgcctttcatattttcccacagccactgtatttttgtctttggaaacaatgtttcttttttcactttcatcacaagcccccactgtctttcttgtcaaagctgacttgaaaaagtaaattccagtgcaagagtaaattccatcggcttttaaattttgctgattttgcaggagtttttttaacaaaatctcttgctttctgttataattaagctagcttatcgaaattttgttgtttttatggcatgaaaaacaggctactggaattcggtgtgtcagactaaattccaccagccacatttaaaaaatgtgaaatgtttacttccagtctgacagcagatttcgatcagttaattagttacttcttaaagcgtatcagcttaggcgttaaattgacttcatctggtgaaaccggcttgagctgaaaggctttaagaacatcttctccaagtgtttccagggcagcatcatacggcgttttgccgtcaaggctttctcttggagtagagtttatgtgattcacaataagattgacatcccattgggttagaaattcaaaggatgttcctttaggcaatatcatgcggagcatggtatgcgcctgttcgatggttcctttttgtccgctacgcattggatcacagtaataaatgctgcttctttgtatgccggtaattccagtttctaattcttctgggttcccaaattcagagccacggtcggttaagatattttcaaaaacagatgtaaattcatacgttcccatacgtttttccaaacggtcaaatacagcacggacggcaccttttgtgcaccggttaataagaaatgcaagaaacagtttttcctctgtaaagatcatggttaacagcgttttctgggagtcccttgatgactttactgtgtccatttgtacataagaatttaattccaaagaacagaagtctgcataggttctgttggtaaatacttcgcggtctttgatctgtgttttgtggcactttcttggtttgaattttgcctgccttttcagatctacatttctggctgtgaacagtcccttatcgatgtatgtgtacatggagcggacagacatatccagttccggatgattgatcaggatctgatagggtgactgtccctgtgcgatcaacggagtaacaatctggtctttttggtgcagctgatgccgggtcatatttatcccggcacgggaactacttaataattcgcggtacttacggtcggcaaaacgggcatcatagcggtatttatgggcaatggtacaatgattgattttcattggacagccattacatacataaggcgccttatcaagtctgcagcaccgttccttttcgaaatccttacaggtttggttgcaggttggacaggatgtacatttaataccgcagagcatgatttttccacaggcatttgtttttttacagtgatagcggtgtacacaaaagtttttggcattgtagaaagttcctttgtggtaccagtcagaaaggcgtcgtgatttaacctcttttgagatggttgtaggatctttacaaaggaatgccgcaatgtctttaaaagtcgcacctttggataattcgttttcgatgtagatacggtcattaagtgttagatgtttctggtttccagggatatatttactcatgataattctccttctactgctgtcagaaggaacttttacaataacactgatgtatgaaagagtaaatatctactgtgcaggactaaattctaccgccctgtagggcagtggaatttaaaatttcattttaggctttcttgtcaaatttctgttattgtatcaattatttttgaattatgatataatacaataacataaaaatagaacaaatctattctatttttatgatttttgtcttagtaccagggggtcatatgaacgaaaatttatttgaatacagtgatatgctgcgctctcctattgaagctttttgctgtggcaccggatactgggaaggtcccgtttcctcccactggcactattttctggaacttgtctatgtgcaggaaggatctgtaacggtcagctgtaatgacaatacctgtctcctgaaaaaaggagcctttattgtatttcctccgcaggcaatgcactccatctatcataccgatgataagtcctatgtttacatctgctgtaaattcaatctcaaccgcataaaactttccgagaattatcttccaaatttaaactttgcctttcaccagattttaaacagcacaaaccctccgctggtttttgattcggacaacctgcccgattttcctgctgaactgtttttcacggatatcttaaaagaggttcaggaaaaacgctacggatatgatgcctgtgtttatgcccagttcgcccggctgatcgtacagctgctgcgtttctggctggaacagggaatttcttttgatacggatcagatcccggaagtggaggaagaagcgatgcagaatgttttgatgtatatcgatgatcattcccaggaaaatatcaatattgaatctctggcgcgcacatatcatatgagttattcttactttgcccggcagttccgtaaatactatgggcaaagctgcaagcagtatatcgaatttgtgcggctgagcaaagtggaaaatctccttttatttaccgggcatgatttaagttatattgcgggagaaacaggctttgccgattgcagccatctgatccgtacctttaaaaaacgctatcagatgacaccgaaacagttccgcttacaacatcagaatatacgaaactgacgtttccaatctatgggattttttcctttttttccaaaaattctttactttatgttatactatagaaaacaaatcataacggaataaggaggaaatcccatgaaacgattacacttcacaaaatgcaggacttctttgcttgctgttttacttgccttttccgtagctttcgtacctgtaccacccatttctgatacaagttccgattctgctgcgcttatcacgactgcacaggctgcccaaaagaacacaaaagaccgtttttccatcaaagaagttccaaaatacaatggaaaatcttctgtggctgtacatggaaataaaccatatttcaccagccgggaaaagcaaaacaccaacacttttgaatcctaccataaactcgacaagctcggacgatgcggtgtggcctatgccaatgtgagcaaagacaccatgccaaccgaagcgcgcggggaaatcggtcagatccggccatccggctggcacaccgtcaaatacaccggtgtcgtggacggcaactatctgtataaccgctgccacctcatcgcctactgccttactgcggaaaatgccaataaaaagaacctgatcaccggcacccgctacatgaacaatgaaggtatgcttccttttgaggaaaaaaccgcacgatatatagacaaaaccaataaccatgtcttataccgcgtgacaccggtttttgagggcagtaacctggtcgcttccggtgtcctgatggaagcttattctgtggaggatcagggaaagggcatttgtttttgtacctactgctacaatgtacagccaggtgttgccatagattatgccaccggtgacagtcatctgagtggaaaaaataaccagacttcccataaaagttctgcaaaggaacacgcatccgcggtctatattttaaataccaacaccaaaaaattccacaaaccggactgtcattcggtaaagcagatgagcagtaaaaaccgaaaaaaatacaaggggctccgcaagaaattgatcaaagacggatattccccttgtaaaaactgcaacccataacggctgccctatttcccaatgatttcatcggtattgataaactcatacggtgtctgctggtaaacgtaataattcagccagtttgcataaaggatatttccatgtgaccgccactgcagcatcggccgctgcgttggatcatcatccggataataattacacggaagcgtgatcgcaagtcccttctccctgtcacgcttatattcactgtctaatgtcatccggtcatattccgggtgtcccatcacaaaaatctggctgccatcctgattgattaccagaaaaacccccgcctcttttgattttgccagaatggtcagttcttcatgctttaaaatatcttcctcccggatctcggtatgccgggaatgtggagcataaaaataatcatcaaatccgcgtaccatcggaatcttgcgattcattacatggtgccggaataccccgaacattttctgctttagatcatatttttggattccgtaatgataataaagtgcagcctgcgccccccagcacaaatgcagggtggatgtcacatgctttttggaccactccataatctcacacacttcatcccagtaatcgacttcttcatatttcatctgttccaccggtgcaccggtaatgatcagcccgtcaaaatactggttcttaatttcctgaaacgtctgataaaacttgttcaggtggctctttgaagtatgggtggatgcatgggatgccggtgcaagcagcgatacgtctacctgtaacggggtgtttgacaatgaccgaaaaatctgcaattccgtctcttctttcagtggcatcaggttcagaatcacgatattgatcggacgaatatcctgatgcatcgcacgggactcatccatcacgaaaatattttcctgttcgaggatctcctttgcaggcagatcactttgtgttctgattggcataactttttctacctcccaccaaattgttctataaatgtatcttcggaaataatcggaattcccagttcttttgccttacgattcttagatgatgcggattccacgtcattgttgacaagatatgccgtcttttttgagacacttcctgtcacttttccgccctggctttctacataggccttaaattcatccctgtttttatagtgatgcacatctccggtgatcacaaaactcagtcccgcacagcttccggaagaagtatcctgcacttctacatgttctatcgaaagttcatgaagcagatcctcaaacccactgtggtttttttcattctgataccaggttacaattgatcgggaacgttccgctccgatcccctcaatatcctcaaacccgtccccctgatgcagacgttgcaaaaagccttcaaaaccaatggcggcaacaatttttttcccggcatccacaccgatcagcggtatgcacagggcaaatataaagttcaccggatgtacctgccggcttttttcaatggactgttccatatttgccacagatttttcaccaaagccctccatctggctgatctccccgaaatgctctttcaaacggaaaatatccgcaaattcatggataaatcccgcattcataaaacggagcatcgtctgaatggaaaggccgtcgatatccatcccccacttgctgacaaaacgggtaaatttcttgacatttttggctgtacagtccggattggtacaatgcagggtctttgtgccactattttcactcacatgaacttttgtcggtgcatggcacaccggacactgggatggaatctccggagcacctacagcatcttttaccgcaatacatttcggaatgatcttattggctttgatcacggaaagtgtacactcttttccgattcccagacgctcgatctcgctgatattgcatagagatgctctcgataccgttgttccctcaatctgcaccggttcaaacacggcaaccggggaaatcgtagacaccgcacacgaccattcgatatattttagttttgtatccacggcctcatcctgccatttgaacgcaaaaccggcgcgtgtcgcatgatgcccggtcacgcttcccgatgccgcataatccgtatcatcataacagatcaccagaccatctaccggaatatccatttttccgctctctacaagtttcgtccatcgatcaatggcttccggaagtttttgggcggttgtcgcttccctgtctaccacatcaaatcccagttcttccagaaagtgcatccgctctccccacgataccatcggctcatccagatgcaccagtgtaaatgcatgaaacctgacatggcgtgccttcacttctgccggatcttccagattcagcgttccggatgccagatttcgcggatttgcatatttttcatcgtcatcctcaatcatgtcgttgatctgtgcaaaatctgtataggatatggcagcttctcctcgcacaaccagatgcccctgatacgaaatcttttgcgggaatcctccgatcgcaccctttaaaaatgtaatgttggtacccaggtttccatttcctctggtaagaatttttacaagatttccgttatcatacgtcagaaccagcgtaagtccgtccagtttccatgacagccagatcggataagctcccgcccattgctgcagttcttccacctgtttggtcttcgccagagaaagtgccggatactcatgcggttctttttgtccgcttccggattcttcatatccggcattctgcgtcgggctgtcctttataatatatccggttttttcttccagcgtggtaagctcatcaaacaaagcatcccactcataatttggcatgatttcatcctgtccgttataatacgcagctgatgctgcattcaactgttttaccagttcttcaatccgttgcttttctgtttccatttttgttctctctatctatatgatgatttaccaccgtatacgtgccatgtatggcagaattgcgtggttttcgttttgatttttgtggtttttccattggtcgcacgggctgattgctcgaatgtgcgatcaactgttttaactttttaaattcctccggtgtaacatcccggtactttcctgattcgagatcccccagttcaatattcatgatccgtacacgtaccagtttctgtacacggtacccaaaatattcacacatgcgtcggatctgtcggtttaatccctgtgtcagaatgatccggaactgtttttttcctgtccgttctaccctgcatttgcgcgttgtcgtgccaagttccacaagcggaacaccgtttgccataccatgcagaaatgcatccgtcaccggacggttcacggtaacaagatattctttttcatgcatatttcccgaccgcataattttgttgacaatctcaccgttattcgtcaacagcaacagtccttccgactctttatccagacgcccgaccggatagatccgtttcggataatgcaggaaatcaatcacattatttttttcccttttttccgccgtgcagacaatacccgccggcttgttaagcgcgatcagtatcatttctttttctttttgtaccggtcttccacagaaacagacctcctgtccatccgatacctgatcccccatccgcgcggtttttccgccgatggttacatttcctgcttcaatctggcgatctgcttctcttctggagcatacccctgcttcacttaaaaatttattaattctgacttccacgtttcttccctgtctgacaaaaatcgcggagacctcacagcctccgcttctttatgatgtctttattattttaccgtttttaataaatcgctcttgatgtatccggttttgccctggaacttcactttcgtccattctcccttggtgccaagtttctttaattttacgcccgcatccacttttccaagaagttctccatctgtacttgcggttttacgcacattgcagatatccttcgtttttacggtttccttgccggaacctgacttggaagacacttcctttacaaattcgctctttacatatccggtttctccctggaattttaccttggtccagtcaccttccgttccaagtttcttcagttccacaccaatatccacttttccgaggagctcaccatccgtactcgggctctttctgacattacagatatcttttgtcttgaccgtaccggtagatttcttggaatcgctcttttgggtatcttccttcttttccgtagactccgttgtctgggtttcctcggtcttttgagtttcttctttcttttgagtttcttcctgtttctttgtctctgtggtctgggtttcctgcgtctggctttccgtctctgtcgtctgggtttcggtattgcttacaatcgtttctctccattttgccatggcatttcgaagtgttccacccaccatattggcaagtttttcatcactctttacagcttcattatagcttgtctgcacctctttctgcagagcaaccacttcatcactcttctcatatgccagaatcagggaatacagatttgcatccagatcctgatccaggaaattgaaattgtatgcagagtatatgttattgatgatcagatttccctttccgtctctctccacatagaagaaatccattcccggtgccggagtatccacacctttgaatttcagatcatagcatacagataccagataagaatcatcggttgccccctttgtggaataacaggtgatgttctgataatcctcataatactcagaaaacgtcgtgatataactcttttcattgtcactgagcggctgtgcaatcatctccagcgaatccgtatctccaccggcatatgccgcataataattttccatcagtgtcacaagttccggatctgcatctttctgcagcttaccaatttcctgatattctgtagtctgtgtcactccctgtgtaccgttttgtgtctctttctgatctttctgcggaccggtacactttaccagaatcacaacaagaatcacaaataaaacagctgcgcaaaaatatcgtctatatttcacaaaaaagtctgtaaacttttttaatttttcattctgcatatgaaccctccataaaaatgcatctttccatttatgataccacacctcatactattcgtccagtaaaaaagcggtgcatgacgcaccgcttttcctgtcgttccatgggtaagttgtttccttgccacatagcataaactgcacccggcgggaatcgaacccgcatctcaggagtcggagtcctgcgttctatccattatactacggctgcatagcactcttatttcacaagtgcctttttactatatcacacttcaaatttagagtcaatccacactttgatgtaaaatatgaagtatttcttccagctgctttaccggaagctgccccggtgcgctcgcctgcccgcctgcgccaaatgtcacacacgatccgaaaaactctccggccacgcgggaaatccccccttttgcacccatggacatggtaatcagcggatgatccggatggttttcatgaaagcggttggtctcctccagcaaatgcaatacatcccacatattctgcggcataactgccagtttcacgacatctgcgccactctcacggatctgttccaacagcatgcggatcacctccgggtccggcgtctgttcaaaatcatgatgggaagcaatcacatatactcccatctcctgcaacctcgctatttctttctgcggattttttgcttcaaaatattccacatcaataaaatccacgacatctgattctgccgccacctgatgaatatcataaatatccgccgcggaaagtgctttgcaccctccctgatttttagaacggaaggtatacaccagaatactttcctttatgatatgtttcatttcgtttaatatttcgcggatcgcattcggactttccacgttttcaaacgcatccacacgccactcaatcatttccgtgtgtgcttcttccagccttctggtttctcttaaaatttcttctttcgaagactccatgaccggcacacacacgagcggtttcccttttcctataatctttccttttatacaaagcagattttccatctctgcacctcctgctgtgttgtaattctctgttattatattctaaaagcccgaaagaaacaaccggttcctgttatttgacatttttcccgttttccattaagatagtcacggtatgtgatatccgaacttaagagataggagaaaaaaatgagttttgaatttttaaaccaattaccgactccggcagacattaagcgcgattatccgctttccccggagcttcgtgaattaaaaaaacacagagacctcatgatctctgatgtaattacaggtaaagattcacgtgtcctcgtaatcatcggaccgtgttctgcagataacgaagattctgtatgtgattatgtgagccgtctgaccaaaatccaggaagatgtcaaggatcaggtcatcttagttccgcgtatttacaccaacaaaccacgtacaaccggcgaaggctacaaagggattgcttcccagccagatccggaaaaagctccggatatgatcgagggtctgatcgccatgcgtaaaatgcacatccgtgcaatcgaagaaagcggtcttacctgtgccgatgaaatgctttacccggaaaactggggatatgtcgaggatcttctctcctacgttgccatcggagcacgttcggtagaagatcagcagcatcgtctgacagtcagtggttttgatgtcgcttccggaatgaaaaatcctaccagtggtgatttttctgttatgctcaattctgtatacgcggcacagcatccacatcatttcgtttatcgcggatacgaggtggagacaaccggaaatcctctgactcacgtggttcttcgcggtgcagtcagcaagcacggcaataccacccagaattatcactatgaagatctgatccgtcttcatgagatgtacgaaaaaatggatgtcatccatccggcagccatcattgataccaaccattccaactccggaaagaagtttaaggaacagatccgtatcgcaaaagaagtgatgcataaccgccagctttcttccgatatccgttctcttgtaaagggtctgatgattgaaagttacatcgaagagggaaatcagtctatcggagatcatatttacggaaaatccattaccgatccttgtctcggatgggaagattccaaacagctgatctatgacattgcggagatgaacgcaaagtaaacagtttttgtctgaaaacaaaaatggagtgtaaaaagtgttccttttgcactccatttttttataatttttctacaacaaaacgtaacagccggattccaacagatgcctccaatacacatccaagaagtaccagtaccgcaactcccatcccccatgccagccgcagcagccatggatttttccggttataaaacctgtgcggttctaccagcagtaaaagcgcaagcgctgcaagatacaaaattccatgcggcagccacgataccagaaaaaaaacaattccaagaatccccatattcatcacacaggcagcaaaaaataccccgccggtaaaataaatcaggcagcgcaataataatggcagaattgcttttaaagcggtaagggaaaggattgtaataatcacaaacacttttcccctttcccataaaatatttgccaaaagcggcaaatacccggtatccgatgccgcaaatgctttcatatgatacgcatttaaaaatccataagtcgtaaaatattcatatccaaacagacaggtacataaaattcccgccaggccaaaacagattccaatcgccagttcctttttcataaaaattcctaaaactcttttcttttcagcctatgccctgtccgttttctttattccatttttataaatccagatgttttcccattccgcctttttttgctgccgcatatgccataattgcagcaatggtttttccatcctgaatttttcctgcatagatcatattgcacaactcttccagtgtgtaaatttccacatcaatggattccgcctcatccagatgtctggtgcccacttccagatcggtagctacaaaaatatcaaccgcctcatcacaaaatgccaccgtcgtacgcagggataataaatgtttcacattcgtgctgcggtatcccgtttcctcttccatctcccgtgccgcacaatacgccgtatcttccgtcttactgtcccgacagccggccggaatttcaagtgtttctctctccagcgcattgcggtactgacgcaccatcacaattcttccatccttcataaccggaagaatggcggctgcgcccatacgatgggatacaaaatcccactctgctttgtttccatccggaagttccatcgtatctttgtagatatccagaattgctcccttgtataccagttctctcttcaatcgttttacatgctctaccatatttcaaacctctctttcctgtccggacatcatccccggatatttttcatcgttcacagtttcttcaaatttgtaacatatccatttcacacttttccggtatagtgaaatcatcaaaaggaaccaaaacctttcgatcatttttttcataatctggccagtgcagccgtgctgtactggtccctcctttttattctatacgtcccgtgaaatcccaatgtatttattttacaacacattatgatataaaaaaaggcttaatcccgctttccgcggtcttaagcctttttaagttcattttcacaattacttagcgtagtcaacaacacgcgattccctgatcacatttaccttgatctggcccggatattccaactcagtctcaatctgttttgaaatatctctggctaaaagaaccatatccgcatcgctgatctgctcaggaacaactaagatacgaacctctctacctgcctgaactgcaaaagatttttctacacccttatagctatttgtaatatcctcaagctgctgtaagcggtttgagtatgtttccaaagtttcttttctcgcacccggacgtgcagcgctgatggtatcggctgcctgcaccagacatgcaatcagactctccggctccacatcaccgtgatgtgcttccactgcattgatgacaagaggtgattccttgtactttctacacagttccacacccagctggatatgagaaccttccatatcatgatctacagccttaccaatatcatgtaataatcccgcacgcttcgccatacggacatcctcaccgatttctgcggcaagcaaacctgtcagctgtgcgacctcaatcgaatgcttcaacgcattctgtccataactggtacgatacttcatcttgcccaaaagccggacaagctccggatgaatgccgtggatgccgacttctaatacagcagcctcgccttcttcacgaatcattgtctctacttctttttgcgctttttcaaccatttcctcgatacgtgccggatgaattcgtccatccacgatcaacttttcaagtgcaattctcgcaacttctcttcgaatcggatcaaagctggaaaggataactgcttccggcgtatcatcaatgatcagatctactcctgtcatcgtttcaagtgtacgaatatttcgtccttctctaccgatgatacggcctttcatctcatcattcggaagctgtacaacagagattgtggtttcagcaacgtgatccgcagcacatttctgaattgcagtaactacatagtcctttgccttcttgttgacttcttccttcgcctgcgcttccatttccttgatcatcttcgcagtgtcaatcttcacatcttcttccacggtctttaagaggtattcttttgcctgttcagaggttaatcctgaaattctttccagttcctgtacgcgctgttcgttgagctttgctatctcaactttctgcttcttcaaatcttcttctttggcacggaaacttgcctcacgcttttcaatcgattcgagtttcttgtccagattttcttccttctgcacaatacgacgctcgttacgctgaatttcatttctacgctctttgatctccttgtcaatctcattcttggaacgaatggtttcttctttgatctcaagcatagcttcgcgcttcttgtcttcggcatttttcacagcctcgtcgatgatgcctctggcctgctcttctgcatttccaatcttggtatttgctaccttcttgtgatattcagtcgagataaaccatacagcaaccgcagtaattataagtgtgataacaacagcaataattacttgtggcacaggagcacctcctttattaagttttcattgtacatataacaaaaagaaatattagtcttccatgtcatacttctacaacattataattttatcctttttgcttaaatatgtcaagcaatacgtgctttcattgtttacttttcatagcacgcagcacatcattgctccgaaagcccctgcgcatcagatactggtaaacacgtgtaaattcttttgggtcggaattttgtgcatcaaactttttcttttccagcagccggataatctggtcctgttcgtccccctcataacattcctcaagggcacgatcaatcaattctccgggaactccctttccatacagttttactttcagctgatagcggctcatacgatcctgacgataattgatataggtacatgcatagcggtaatcatcgacataatgaaaagatttcacatattcaagtgcaagatcaatacacgcctgcggatatccgccctgtttcagtttctcccgcagctgctgctctgtacggtccatctgttccagcagatgcatggttcttctttttgcacgctttcccaccacttcataaatcagctgatgttcctcttcatccgaaagtgtgcttccttcccgcatccgaaactgttttgcctctccccggtaaagaacaagctccgttccattatccagatggaaacgaagcctgccctttcccagagtcgtacactctgtcactgtaaccatatcttattcattcttgctttccgcatctgcagataccggagtctcctcttcgctttccggagcctcatcctcctgtgcaaaataatgttcacgcaccatttcttcaatcatcttacagaattccggattttcacgcagatacgtctttgcattttcacgtccctgtccgatcttgtctccttcataagcataccatgcaccggatttgctgataattccgacatttgctgccagatccagaatatctccctctttggaaataccctttccgaacatgatatcaaactctgcttcacggaatggaggtgctactttgttttttacgactttgacacgggtatggttaccaatgacttctcctgcctgcttgagctgttctacacggcgcacgtccagacgaacagaagaataaaacttaagtgcacggccaccggtcgtcgtctccggatttccaaacataacaccaactttttcacggagctggttgataaagattacaatacagtttgacttgctgatcacaccagtcagcttacgaagcgcctgactcatcagacgtgcctgcaggcccacatgggaatctcccatatctccgtcaatttccgcctttggcacaagagctgctaccgaatcgacaattacaatatcgacggctccggaacgcaccatggtctcggtgatctcgagcgcctgctctccgcagtccggctgggaaatatagagattgtcaatatcaacaccgatgttctttgcatagacaggatcaagcgcatgctctgcgtcaatgaatccggcaattccgccctgcttctgcacctctgccacacagtgcagtgcaacggtagtcttaccactggactccggtccataaatctcaatgatacgtcctttcggaagtcctccgagtcccaatgcaatatccagactgagggatcctgtaggaaccgtttccacgttcatatttgcggaattgtcccccagcttcatcacagatcctttgccatactgtctctcgatctgtgcgattgccgcatccagtgcttttaatttatcgtcctttgccataatattctccttcttatcgaacctatgttcgtatctatgttctaatagtagtatattttgtttgtattgtcaatgcaaaattttaaatggggaaataaaaaaagacagtcgctctgcaactgccttttattatacgttgtatcctgctacgcgtcaagaagtgttttcaggtaatcctcaatcgcatcctgcgtctgtaaccctatcatcttcttctgaaacattccatctttcatgaataccagcgtaggaatactcacaatctggtaatttaatgcaagctgtggctgctcgtccacatttactttgcatactttcacctgatctcccatcgattctgcaactgcatccacaaccggtgactgcatctgacaagggccacaccaggatgcccagaaatcaatcacgaccggcacctttgcgccgacaacttctgcttcaaagttttcttttgtaattgttacaactcccatgatctttcctcctttgattaattcttactgaactcggataatacgagtccttcgtttcggtcaagtgtcatgccgacactccatgcattgacaaataaaagaagcggatttcccttcatatcaatcactttcttcatatctgaagtaccagtcagcgcgtccacatccacttcctccttgttctcgatccagcggatatgttcatatggaagattctccagacggatctccacattatactcgttttccagacggaaccggagtacatcaaactgcagcacaccaactactcctactatgatttcctccataccgcctttgtattcctggaaaatctggatggcaccttcctgtgcaatctgtgttactccttttacaaactgcttgcgcttcatggagtcgatcagacgtacacgtgcaaaatgttccggcgcaaatgtcgggattccctcaaactgaaacttgtcctttgccgtcgtgagggtgtccccgatagagaaaatgccgggatcaaagataccaataatatctcccgcatatgcttcttctaccattttacgctcgtctgccatcatctgctgcggctgggaaagcttgatctgtttgtttccctgcacatggaatacttccatgcccgccgtaaacttaccagaacagatacgcataaacgcaatacggtcccggtgatttttattcatatttgcctgaatcttaaagacaaacgcagaaaaatcttcctgaaacggatcaatcattccgatgtctgatttccgggccattggcgcataagtcatcttcaggaaatgctgcagaaaagtttccacaccaaaattggtcagggcagaaccgaaaaataccggggaaagttctccctttgtcacaagttccatatcaaattccgcactggcaccgtcaagaagttcgatttcgtcatccaaaattgattttttctcctcaccaatctcgtcgatcagtgccggatcatcgatatcaataatcttttcggaaccttcttttgttccctttaatgtatcggcaaatgtcataacttttctggtatgacggtcatatacacctttgaattcttttccggaaccgatcggccagttgaccggatacgttgcgattcccagttcattttcaatatcatcaagaagctcaaacgtatcatttgcatcacggtccatcttattgataaatgtaaaaatcggaatatggcgcattacgcataccttaaacagcttacgagtctgcgcctctactcctttgcttgcatcaatcaccatgactgcggaatccgccgccataagtgtacggtaagtatcctccgagaaatcctgatgtcccggggtatccagaatattgatacagtatccgtcatagttaaactgcagcaccgacgaggtgaccgaaatacccctctgcttctcgatctccatccagtcagacaccgcatgtcttgctgttgcctttccttttacggaaccggcaagattgatggctcctccgtaaagcaggaacttctccgtcagagtcgtcttacctgcatccggatgggaaatgatagcgaatgtacgccgtttttctatttcttttcttaagtcactcacagtatatcctccaaaccaattgcacactgtacctcattttatactaaaaactatgtatttgcaagtgctactggatgggagtgatcacgatcttatctgcggatactccggtcttacgctttacaatatcttcgacctgcgcccgcttggcatcggttgcctcccccatattaagaaccacatcacagccgtcatcattcatactgacaaccacatccgtaaacccttttgcctccagcatcatttctgcattggactctttctccgcaatatccgtcagtgtaatcatttcattgaccgcatctttctttttggactcatccaaagaatcattgtcaatgattgcctgcagggtttctttatttttggaacgcacctgttcccggttaagtttcacttttgccgcatagtcggaatccccgcttgtcacagaggtaagtaccgtctctcccggattttccacatcttccgtcgatgcatccgccagatcttccttgctgcttgtgatatccagatcctccccggtttcataatctttatccgcctggtcacttacggcaccctgattcatattagctaccgtctcggcatctttgatatcagcgccctttttgtcataagtaacataaccggccaccgcaatcagcaccgccagcgttgtaataacaatctgatttttatgcactctttttttcacgtctattcctcctgtaccgacattttaactactactaccttatgcgcttccaccggaaataatgacattaccgcgttggaaatttctgtaacggtctttgcatttcctccaccctgtgccacaaccacaaccccttcaattttcggcatctgcctgcagatcacatagggctgtctggtatcaccggtatcgtacaccaccgttgtctcttcctttttgtttccatcttttgtcacatttttatccagctggtcggttccctcatcggaaaatgtcagcattacacgggtttttcccaccccgtccatgtgttcaagcagctccttcagctgctgctgcagctgctctttataggaatcttccgtctgcagctgctgctccttttgttcctgcgtctgtgtttctttctggctttgttttgcccccgtcggcatcgcaacgatcattaccatcaccccaagcagaatcagtacaacgaaatccgatttattcctctttttgatccactttcccaagatactgttcaaaaatattctctcccttctcctgatattctatgctttccatctgctcgacaatctcatgcagctgctgccttgcctcttcttttttcattcctcccacatagaccaaaagcggctgtgccagcacggtgatcacgagcacgctgacaaaaaaatgaaaatatttctgataggtttcctttggtgtcagatatgacaacagataaaaaatcagcatcagcacgaaataatttttcacaaatgtaagtacaacttccatgttctcctcccttctcaatagatgaaactggtggaaacactgatcatggatatggtaataaaaaataaaagcagcgcatccagctgtatggtacaaaaaagcgcgcatcccctggcagcggcctgcacacactgcgcaatccggctgtctgcgaccggtgccaaaaatgcagcggtcaggcggtacatcacagaaaaacagaaagatttcagcagcggtgtcatcccgattacaagaagaaggataagggaagccgcgccaatgctgttttttatgaggattccgcttccgagcaggatctctgctgcggaaccgaaggtatttcctactccgggaaccgcggatatactgttaaaaatactgtttgtggaaagcctgtctcttgcaggtacaatcagagactgtacaacaccgattcccataacggcagtcagcccgccttttaagaccagtcgtattccgtcttcgaacagctgcgccatctttccaagttttgtttcctcaaacaggttatccatcagaagaagcagcacaaacacatgaacccccggcagaaaaataaatttcattcccagttccagcagatacatcagtccgaatgccagctgataaaaggaacccgcagatgccgcattgccggagcaaaacagcgttgccgcatacaaaggcacaaatgcggtcataaatgccaccagacggtcaatcccctgatctaccacctctgagatcagggcaaatgattgcagcaataacagaaccaccccaagataaacaataaaaaagctcatctgcgaaacatacccctgtcgcgtcatcatcacttttccgtacagcgcaaataaaagtcctatggcaaacatctgcaaaaacatgggctttgcagccgtgatttcataaaaaaataaatctgcaatatattcacagatcattcccgcatccagtccgcctgttccttccgtcaccagtttattcaccattttttcaaaatccatcttttccggcagatcctgcgtctgtgcattgatatccgtaaaatcaagttcttttatgatctcatccgcctcggccgccatcacattttgcggctgtaaaaaaatcatccatacgaacaaaacagaccagaacaaaattttagcaatttttttcatttctaccccccggtcatctgttcgatcagccgcaacaaaacccacaattccggaatggacaaagcaacgatcgataattttgcaaacagttcaatctgtcctgcgacagatccatatcccgcttcccggcagaccgatgcggaaaaatcggcaacatatgtaattccaagcatctttaacagtgctttcaaaagtgccggatctaccggaagcgtgtccatcagttcccgtaaaaaatccaggataaacgaaattcttgacagtgtgtatccgaaaatcaaaaccgatgctgcaattcccacaagcaacgccagctctcccttttcttttttcagtaaaagagccagaaaaaccgcagcaattccgatcattcctatctttatcatagacatcacatacgaaacagggtttccatcgttgtaaacagttcactgatacaaggcacgatccagaacaacactattatcagacctgccaggctcagcagaaatgcctgttcctcccttccactatgcttgagaatctggctgagtactgccacaacaattccaagcgctgcaattttaaaaataattgttacactcatacactcaaggttcccttcctacgcctttacaccagaagaatgatcataaccacgccggtcagcattccaacaggcagatacacccgctgtttttttaaaaattccaatcgtgactctgccagaaatttttccatccgttttctgcagatttcattgcatcgcagattctctgcactgctttcgccataaaatgctcccgcggcagacgtaaggatttcccagccctcctgcccgatctgcagtttacttttgtgcttctgcagacaatcctgccatattttctgtccgcttggattctgatggttgcgcatacatacacagacctcatccagaaatgcctgcatggatgcatctgccgtttcataaaaagacaaaaaatcgtacaaccgcacatgttcctgttccagtgcatatccccagcgcacaaacaggcgtatccattcccccgccatccgctgtctggctttttccccctctgcccatttgtacaaaaatccggcacaccctgccagtatcaggacggttccgaaaatccttgccacaatggatttcctcctccctcatatacggtgagaatccggcgcccgtccggttctctctgcagaccgatgagccgcatctgtgagcggatcagatccagtcctcccatctgcaggcggtgcaaaacctctaagacactgccggcatgtatggttccaaggatcgataccccgcaccgggcacagtctgccaccgcagcaaagtcctccggaagtcccagttcgtccactgcaatgatctgcggggacatggaacgaagcagcatatggattccatgttccttcggacaattgtccagcacatccgtgcgggggcccagatcgttttgcggaattccccggtaacacgcggcaatttccgaccgttcatcgactaccccgacctttttcccggcacgcaggtgatttcctttcgaaagcagccggatacaatcccttaaataggttgtttttccgacccccggcggtgcaaagaaaaacgtatgatatacattctctccgcaatacagccatggaatcagtaccgatgcacacccctttttttcgtgagccagacggatatttaaaccgctgatacagcttaacagcttcatacagcttgaggttccgtgtttctcatagcttgcccgcccagaaaccccgatcctgtgcccgccttccagcgtaaaatacccctgtcgcagttcttcttccagtgcatacacggaatatccactcagataattcagtacctcccgcatatgtgcttccgtgagcagcccaatctctttttctttctcatccccatataaaatttccagcggttgtccgacccgaagccggatttcttctgccccgcacaacgtttctgcttccatctgcgttcgaaaatctaccggaagatattctgtaatctccattctgtcacttcctccatgtttctttccataaaaaatgagccataaggacaaatccctatgactcatttatatgttttatatgtgattttagaacatccgatttacatacggtccggtgcggaaaaaccaagcacatcgatacaggtctcaagaatatttttggtcagtaccaaaagaccgatataagaagcctgtaccttaagatcttcctcggaaagaatctttgtctcatgataaaatccgttgaatgcattggccagttcataaatatatgcacagatcttgtgcggtgctttctcctcatatgcattttccatcatggcattgaaacgtgacaatacaagcatcaggttcttctcacttgcagaatgtgccccaagaatcggtgcatccggcagcgtattttttgcagtgtatttctttaaaatggatttaatacgcacaatcgtatataaaatatacggtcctgtattcccttcaaaagaagtaaaacgctcaatatcaaaacagtagtccttgcttgcctgattggacagatctccgtatttgactgctgccagagcaaccgtttttgcagtctgctttgcctcttcctcggaaatatcgaggttttccttttctttctggttctctgtaatctttttgagcatctcctcattgatctcatcaagcagatattccagacgcataacgccgccatctcttgtcttaaacggtttgccgtcttttccgttcatggtaccgaatccgatatgggtcagttccacatccggtccgacgagtccggtctttcttgcacagcggaatacctgtacgaaatgcatgctctgacgctgatccgtcaggtaaataatggcatccgggttgtaatcctgcatacgcatcacaatcgtagcaagatctgtcgtactgtataacgaagctccgtctgactttaagatgatacatggcggaatctcttttgtatccgtatcctctttgacatccacaaccagagccccttcgctcatgtaggcaaagcccttgtccttcatcatctgtaccatatccggaatatacggctgtgcatccgactctcccttccagagctcaaaggagacattcagattatcatagttcttctttaaatctgtcacggaaacatccagaatgtgtgcaagaagtgcacggtatccccgtctgccggcctgcagctggctggttgcctccatggcagcctcacggaacgcttcgtcttccttactctttttgctggcagtcggatagatatcctccagttcggaaatggtaaacggcgcctctttcggatattctccggtatagctttcatcataatataccagatccggcttacgctcttttaattctacaatgatcagtcccatctgcagaccccagtctcccagatgcacatcaccgatcatgttatgtcccataaatttgccgatccgcttgatactctctccaatgacagcagagcgcagatgtccgacatgcaatggcttggcaacattggccccgccgtaatctacaataatggtcttcggatgtgccgctttgtcacagccaaatcttccctcatctgctttcatatcgctgacatatttcgccagataggcaggacttactttcatattgataaatcccggttttacagactctacgctctcaaacagttcgttttctgccagcgcctgcgcaatcttatccgaaatcatgaatggtgcacacttgtactcctttgctgcagccattgctccgttacactggtattcacacaggtccggacgattggaaagtgtaactttcccgtattttgcatcatatccctgaccggtaaatgcatttgtcacctgctcggtgatcagatctattaatgtcttcatcctagggttctcctctttttttactacagattattgtatacatcatagaagaaaaagtcaaacgcttcttcgtatctgacatttttcttcatacaaaaacggctgccacattacgcggcagccgtctccacttttatcagttctatccgttattgtctaattgttctttccggaaaggtactcatcaataccctttgcagctgccttacctgctcccattgcaaggataacggtagcggcacctgttacggcatctccacctgcataaacaccgtctttgcttgttgcaccggtatcttcggttgcaacgatacacttgcggcggtttgtctcaagccccttggttgtggaagaaatgagtgggtttggagaggtaccgagtgacatgatcacggtatcacaatccatctcatactcagaaccaggaatctccaccggacttcttcttccggacgcatccggctcaccgagttccatcttgatgatgcgcacaccctttacccagccattctcatcgacaagaatttccgtcggattctgcaacagatcaaaaatgattccctcttcttttgcgtgatgtacttcttccttacgtgccggaagttcttcctcaccacgacggtatacaatatgtacctctgcgccgagacggagtgcggttcttgcagcatccatggctacattaccaccaccgacaacgacaactttctttccatgggaaatcggggtttcatatccttcctcaaatgctttcatgaggttgtttcttgtcaggaattcgtttgcagagaatactccgtttgcctgctcgccagggattcccatgaaacgtggaagtcctgctccggaaccgataaatacagcctcaaagccttccttttccatcagctcatcgatctttacggatttaccgatgacaacgttggtctcgatatccacaccgagtgcttttacgttttctacctcggctgctacaaccttgtcctttggaagacggaactccggaataccgtagcttaacacaccaccggcacgatgcagtgcttcaaaaatggtcacatcgtagccaagctttgccagatctccggcacaggtcagacctgcagggccggaaccgatcactgctactttgtgtccgtttaacttctctgctttctttggcttgataccgtgctcgcgtgcccagtctgcaacgaaacgctctaatttaccgatggcaaccggatcacccttgaaaccgcggatacatttaccttcacactggctctcctgtgggcagacacgtccacagacagccggaagtgcggaagactcggagataatatgataagcctcctcaaaattgcgctccttgacctgtgcgataaatgccggaatattgatagaaaccggacatcccttcatacactgtgcgtttttacaatttaagcaacgggaagcctctgcaactgcctcttcctcgttgtatccataacatacttcctcaaaattcgtagcgcgaacctttggttcctgctcacgaaccggtactctgactaatccttccattacttgtcacctccgcaatggccgcatccaccgtgatgggtagcgccctcttcatatgcgagctttgctctgccttcttctgtcttatactgctgctgacgcttcattgcctgatcaaagtcaacgagatgtccgtcgaactccggtccgtcaacacatgcgaattttacttctccgccaaccatcagacggcatgctccacacataccggttccgtctaccatgatcgggttcatggatacaacggtaggaatctcaagcttcttggtaaggattgtaacgaatttcatcatgatcatcggtccgattgcgacacatacatcataatgttttccctcatcgatcaatgcctgtaactgctgacagccatttccgtgaaatccgtaagtaccgtcatccgtacatacgtatacatttccggctactgccttcatctcatccatataaaaaagcagatccttggtacgggaacccatgatcacgtctgcatcaattccgtgctcatgcagccattttacctgtgggtataccggtgcggttcccagacctcctgcgataaatacaattttctttttcctggtctcctcaaggttctcctcctcacagagttcggacggacatcccaaaggtccaacgaaatcttcgagagcatcgccctcatttaaggccatcatacgctcggttcctgcgccaatcgtctgtaccacgatggtgacagtctccttctctctgtcatagtcacagatcgtaagcggaatacgctctcctacttcatctgtctttgcaatgataaactgtcccggcagacactcattggccacacgcggtgccttgatgtccatcaggataatgttatctgccaatgtttcttttcgaacaatcgggtacataaactgcctcctgtatgtaataaatttaatctaatccctgttctctttttctgctgaatacaaaaagaggtgtatagcacacctctttattgtatatgacttcttcacttttcgcaacgacttttttacgaaaaatatacaagctcatcttccggtttctgggctttttcgatggaaatcgggtaaagaaccggtccttttcccttatattcccgtgcaaattcgacacgaatctctgccgtaattgtaatccatgacttgtgcggaagttcctcttccctgtcatatttacatttgaaaccgataaatgtcacatcctcaatgcagcaggtcatcgcaaaccgtcccggaacaaacacgcctttcttaagtttatccggattatataccagagccaggaattttactttcttgcgatcgtatttcttgtaattttccatggcatccatgtaccagatagcataatccgcatcggtcagctcaatcacatcctgattgatatcaaacggtaattcctccggacgctcatcaatcgttccgtccttgcgctcatagacaatctgtgctttccggttgatgttcttaatggtacggcgcagatgtccgcgatcggtatcatcatctgtacggttaaaaataaccacatcactggaaaaaacctgttcctgcatcattgcacgcatattattcatatacagatcatacgtcgtggaatccacggttgccagtgactgtacaatcacccagccctccggcatttttgcctcaagcagcttgtccatcccccaggtgccgttgtactcgataaaaatttgttccggctgataggtgtcctggatttcctgcagttttgcaggcgtaaaatcctcttcctcttcgaccgttaccagcttgaagttgattgttgccagttttgcttcgtcatattctttctcgccgtcttcgcacatgatgataattcctttcgaaccatcaccgaagttattctcaaacagcgtttcttctacgagagttgtttttccgctgtccataaatcctgtaaataaatataccggaatatcctgtgccataattgctctccttacatttttcttggggtttacagcattttaaagaccaaatgtcttcagtaattcgtcctcatgaatctccgttccgattaccacgatacgtccggtgtaatccggctcgccctcacggatctcatactcgcccggaaccatatcaaagtacagccaggtgccatcggtactctccaccatccctttggagcggagaatattgtcagaatcgacaaacttcttaagtacttcctcaagttttgcacgctcaaatttgtgcggtgtctccttgccccagctggtaaatacgtcatctgcatgatgatggtgatggtgctcatggtcatggcagccacaggtacagttttcatcatgctcatggtgatgctcatgctcctcatgatcatggcagccacaggtacagttctcatcatgttcatggtcatgatgatgttcatgatcttcgtggtcatggtgatgctcatgctcatggtcttcatggtgatgctcatgttcttcgtggtcatggtcatgatgatggtgctcatgctcatgttctgcctcttcctttgcatgatgtgcctcggcaagagccttcatctccagattatcctgtccttccattaccttaaggatctgttctccggataatttttcccagtctgttgtaataatggcagcctttggattcagttcctggattttgttgacacaaaactccagctgttccggtgttgcattctggctgcggcttaaaatgacagttgtcgcatactcgatctggttgttgaaaaactcaccgaacgccttcatctgcttgctcgccttaagcgcgtttacaaccgttaccagtgcgtttaattttacatcctgctctttttcaatatcaatcacggacttcataacatcggaaagcttaccgactccggatggctcaatcaaaatacgatccggatgatacttggtgatgacttcatttaagttctttccgaaatcaccaactaaagaacagcagatgcatccggaattcatctctgtaatctggattccagcatcctttaaaaaaccaccgtcaatgccgacctcaccaaattcattctcgataaggacaatcttttctccagtaaatgcctcatctatcatctttttgataaaagttgtttttccggctcctaagaatccggagataatatctatttttgtcatgataatccactcctttttgttttttcaaaatctattctattttactcgtttttttataataatgcaagttgtgacacagccggtctaataatgcatatgataaagtttttcatacacaccgccccgtgccagcagttcttcatgggaaccggattccgcaatcccatcttctgtcagaaccagaattttttgtgcattctggatcgttgtcagacggtgggcgatcacaaatgtcgtacggttctttgccagtttctccaatgattcctgtacgaccctctcgctctcgttatccagcgcggaagttgcctcatcaaaaatcagaaccggtggatttttcaaaaaaacacgggctatggaaagccgctgcttctgccctccggagagcttgattccacgctgtccgatatctgtatcatatccatcgggaaatgccatgataaattcgtgggcattggcattttttgcagcagcaatcacttcttcccttgtcgcatccggctttccataccgtatattttcaaaaatcgttcccgcaaacaggtatacatcctgctgcaccattccgatatggtcacgcaggctctttaacgtcaccttacggacatctttcccatccacgcggatacatcctccggtcacatcatagaatctcggaatcagggaacaaagcgttgtctttccggcaccggaggatcccaccagtgccatatatgcccctgcaggcacatgcagattgatccggttaagcaccttctcctgattgtctttatactgaaaagaaacattttcaaaatcaatggttcctttcacatcggtcagtgctacagcatcgtttgcatcctggatttccggttcaatattcataatttcctgaaaccgttcaaatcccgtatagccattctgaaactgctcggtaaagtccaccagtgtccggattggatccgtaaataccccaatatacagcaaaaacgtaaccagatcattgaccgtgaccattccctttgcaatgagaacccctccggcaaggatgacatttacctgaatcagtgttgtaaaaacgccaaccccggcctgaaaactgcccatgtaatgataactgttcttctttgccgcaagaaatccgtcatttccatgacgaaatttttcgttttcaatcgcctcattggcaaacgatttcaccacacggatgcctgacagattatcctcgatctgttcattaatctcggcaattttaatacggttctgctgaaaagcccggcgcatccgcttatttaacgcaaatgcaaatacaaacataaccggaagcactgcaaacgcggcaagcgcaagccatccattaatgttgagcaggatcacaaacgctcccactatctttaataccgacaggataatattctccgggccatggtgcagcagttctgtaatatcaaataaatctgccgtcacacggctcatcagctgtccgacttttgcatcatcataaaaagaaaaagacagcttctgcagatgcccaaacaattcggcccgcatgtcatattccatttttgcccccatcacatgtccataatttccgataaaaaaccggctgtaacagtccaatgccagaagcacaaacaatccgatgccaatcaaaaaaagtttccgcaacatcatctggggctgctgataaatcagagtcgatgtcacataccgcacaaccagtggaatagtcagtgccactgccgcagaaagtgtcgcaaataacatgtctgccgcaaaaactgcccggtagggtttgtaatagcttatcatttttttcagattttgattcatggttcacctcatcctgatcatttctgcaaaaaagcaccccgcgagttgtcccgcggggttaaatacattagttgtattttctttttctagcagcttcagatttcttcttacgctttacgcttggcttctcgtaatgctctctcttacgaatctcctgctgaataccagccttcgcacagtttctcttgaaacggcgtaatgcgctatctaaagtctcattctcttttacgattacactagacattctttcctaacctccctccagttgcgatattgtgcatcaactgtaaggtaatcttaattgcactatcgattattttaacaaaatatcctgatttgtcaatagtttttccgaaatttgcacagtttttttcttcctcgcgcttaaagttttgtaaacacggaagtttctttcttcaatccctctgcaatcgcaaagttctcatccatcttcttggaaattttatccatatcggatacaagaacctgtgtgctgtccgctgccgaaacgactccactgacgccttcctcgattgcatgggaaatcgtatttacggaatttgcaatctcatccatggaattctgtaaagaatccgtctttgcctcaaaatctgccatgacgctttcaataaacgttgccttgtcatgatatgcgccaccggattccacaaacttctggaattccggcaggattttttcattcatgtactctaccagtccgtttgcattgtctgcaagattatgtactgcagttatgacaatggcattgatgctctggatattgttagccgcttcctgactagcggctgccagctgactgatttcggaggcaaccactgcaaatccttttcctgcatccccggcacgggcagcctcaatggatgcgtttaatgcaagcaggtttgtctggcttgcaatatttaagatgtcgtttgtcagattgtctacctggttgacactgttgctgtcctcaatcgcctgactcagcacggaaacaatatcatttactttcgcacccgttgtatccatattttcacgcgcagcatgttccattgcctctgcatgctctttcatttctttggtatactgattaatttcaatcgttttctctgcaattgacttgacttcaccggcaaccgattcggtattttcattaatccgtgaagcattgtcggaaatatcctgcatcgttgcagaaagttcttccgtcagtgcggatagatcggatacacttccgttagaagtctgcacactctcacgcacttcatttacaacaccctcaagatccctggaattgctgctgatcatccggaaaatttcctgcagctttgccataaaagcattgatgcctccaccgacagatgccacttctttgttgttggtaatggtaaccctgcgggtcaggtcaccctgctggttatcaattccggaaataatctcattaatttccctgttcgtatttgcaagcggataaattacccaccgaagcactgccaccattgctgaaaaaagtgccgcaatactaatcagaatcgtcactatgcttgttccgattgaactatggtatgcagatgtcagtttctgtctctgtgcatttgcatcctggtttacaatttttttgatactttcgatatccgactcaatggcatctgcacacttgctgatctttccattggcaagttcataggcatcttcctttttccctgctgcggaaaatgccataacattggcacattcatactttaattcttcgtatttttttttgatgtcattgtattctttttgggtatccggtgtcacgtatgtcttgtaactttccagatctttctccaatgcatcttcctgactgcggattttttccaccagctggatcatggaatccagatccaccgctatgatatgggacagtcccagattatggatgtcctgtgtctgtctttgtatttctgccagactcgaaacattctttaaagatacttccgaaatctgtacggcactccggttaacgttcttgatattagaaacagacatcacattcgagatgatactgaatattccaagtataaataccggaattaaaatgataagtttggtacttaatttctttttctgattcatatgctcccacctcttagcctgctactgattttgtaataccactgaccagattatccatcagttcctgtaactttacgtggtttggatttcctgctgccatcgtattcccgaatgtcttgcatgcatcccagtaactgtttccgacacgctgtagttttccaaattccgactgtgcaatcactgcctgaatggatggggaagctttaaccgcatccgaatccgccgcctttgtattggaaggtccctgtccgttcatctcaaaccggacggtctggttctgctcattggtcatccagtctgccagttttgctgcccactgcggatttgccgaataagcattgactcccataagcttatagccggtaaaggaagccatctgtacctgctttcctgccacggtataggtcggaagcttggctgcgccaagatcatctccccagatctttttcagttcggtctcactccatacaccgcttacccctgcaattacactgccttttttggcatttgtaataaagtcttcattcaccgcattttcaaatccactgctggaactgatatcaagcatcgcctgcgcaatatccacacctttgatctcccctttggtggaattccagtcacagtggtttgtcacattgtcatcattgacaccgaaatccagtcctgtatttccgaaaaacgaatacagataccagccggaagaccagtccatcataaacttcttatgatttttttctgctacttttaaaatgccgtcaagggttttgacatccgaatcgctcaggtactttttgttatagtacagaaaatacccattgtccgcagtcatgggatatgcataaagcgtatcattgactgtggcagcgtctattgcgccctccacatttgcttttttcacttcatccacattcggaaccggatacaatgcaccaccggccaccatagaagccacctgatcatctgcaaggataaacacatcagctgcgttatgcacatctccaagcacattgtcacgcgtatcggaatccgcattctgttccagggtgatatcaaaagttgcctgacccttatactcttctttgaaactgtcgatcatcttattcaacgcatcatacgttgattcctctgcccacactctcagttttaccgttccgctcgtcctgtccgtctcctgtgcgccgccctgcgtggtctccgttgcaccctgaggcaccgccgatgcgcagccgcccagcatggacacgacaaagattcctgccagcacggccgacaataacctctttctcttcataaagtctctccctttcttcatgtcgtttccaccttttgttgtatatacacaaatttcacagtggattaactgttattatactataaatatttgcaaaaaacaggtaaaatcgcatttttattgcgcatttttacctgttttttgcgtttttattatattcttttatacgttatcagtgatagattatttcaacatgttttccagtgccgtcttcgcctgtgcaattgcatccggaataccagccggattctttccaccggcctgtgccatattcggacgtccgccaccgccaccgccgacgtttccggcgatcgccttgatcagattaccggcatgtgccccctgcttcatcgctgcatcggttgccatggcaatcaggtttacctttccgtcacaatcggatgcgatcactacgacgccctcaccgatcttgtccttcagctggtcaccgagatcacgcagaccattcatatccacaccagatacgctggttgccagaagcttcacacctttgacatcctcgatctgattcatcacatccccaagtgcatccttggctgccctgctctttaacgcctcgttctcgctctgcagatctttcatctctgcggtcagatgctccagacgttccttaaggtttgcaggtgtagactttacaaccttcgctgcttcccggaactcttcttccatctttttgtaatatgcaatcacattgtcaccagtcagtgcttcgatacggcgcacaccggctgcaacaccgctctctgaaagaatcttaaatgtcttgatctctgcagtattctttacatgtgtaccgccacagaactccctggagaactctcccatggaaacgacacggactttttccccatacttttcgccaaacagagccattgccccggtcttctttgcctcatcaacggtcatgatatcggtacggacttccatgccctcgttgatcttttcattgaccatgatttccactttctgtaactcttccggagtcatggctgcaaagtgggtgaaatcaaatctggtacgctcactgtcctgataagaacccgcctgctcgacatgtgtacccagcacttcgcggagtgctttctgcagtaaatgggttgccgaatggtttgcacaggtctttgcgcgaaggtctgcatctaccatcagttccacttcctcgccggtatggatcatgccggacaccatacgcccgatatgtccgtatttaccgcccagaagcttaaccgtatcctcaacctggaatacaccgtccgccgtacggatctgtcccttatcgccctgctgaccgcccatcgtggcataaaacggagtcttctctacgataatggttcctgcatccccatcggaaagtgcttccacgatctcggtctcggtcgtcataaccgtaactttagaagcatatgtcagattctcgtatccgacaaattctgttgtgatggaaggatcaatctgctcgtaaaccgttgcatctgcccccatgtagtttgtcactttacgggcacttctagctttctgcctctgttcttccatacaggccttaaactcgtcctcattataggaaaagcccttttcttcaaggatttcttcggtcagatctaccgggaatccgtaagtatcgtaaagtttgaatgtatcggcaccggaaagttcctttttgccgtttttcttcatctcctccatcaggtcagacaaaatggcaagtccctgatcgatggtcttattgaatttctcttcttcctgtgtcaaaaccttaaagataaattctttcttctcttccagttccggatatccatccttgctctcattgatgacagtttctgataattttgcaagaaacagtccgtcaattccaagcatctttccgtgacgtgccgcacgacggatcagacggcgcagaacgtagcctcttccttcattgcttggcataacaccatcggatacaagaaatgtggaagaacggatatgatccgtaatcagacggatggatacgtcatccatggcatctacttcatacttctttccggacatctcacaaatcttgtcgcggatcgctttcatggtatcaatatcaaatacggaatccacatcctgcataacaactgccagacgctcaagtcccataccagtatcaatatttttctgggaaagctcggtataaccgcccttgccgtccccttcaaactgtgtaaacacgttgttccatacttccatgaaacggtcacaatcacagcctactttacaatccggacttccgcatccgtatttttcgcctctatcatagtaaatttcagaacacggaccacatggaccggcaccatgctcccagaaattatcacattccccagtctcaggatcacggtaaaaacgtgtgattttttctcccggaacacctacctctttggtccagatctcatacgcttcctcatcttctccgtaaatggacggatacagacgatcctcctcaagcccaagtacctttgtcaggaattcccatgaccaggcaatcgcttcatgcttaaaataatccccaaaagagaagtttccaagcatctcaaagaatgtaaggtgacgcgcagtctttcctacattttcaatatctccggtacgcacacacttctgacatgtagtcacacgtctgcgtggcggaatctcctgtcctgtaaaatacggcttgagcggtgccattcccgcattgatgagtaataagctgttgtcattgtgtggtactaatgaaaagctcttcatgacaagatgtcccttgctctcgaagaagtcaagatacatccggcgcagctcatttacgccataactctttttcattaccagttcctccaaaatcattctttcgtcgtgtcagccttcgcatccttgtgtctgcggagtctgataccaataaatgcccctaatccgccgatcaaagccaaagcagccatctcgaccacatatctgccaatacataaaagaaaatctgtcatatagttttctcctctctgttgttaccccattaacttaattattatatatgaatttttctgtaaattcaagagttagagttccccgaacggaaatacctgattctccctttcaatttcaattacgcggtctgccattccaagatttgtaatgtgttttttgtattccctgattgcagaataatcctgccacatatgcatcggaaaaacaaattctgcatcggtgtttttcagcacaaaatcaatcccgagtgtctgatacggtcccagccgcggatccatcgggacaaacgcaaaattgaccggcttgtccgcaagcttacgaatctcgtgccggaaagtgcgttcctgtttgccgtttataagttctcccacatgttccatcttccagtcgtttaaatctcctgcatggaagatgctcaccccacgcacattcacataaaatgccactcctgcatcggtagacaaaagggtctggatctttagatcatccacttcataatggttgtttgcggagacaaacgtcacttttttccgcacccccgggtcaattccatgcttttgcagaaaatgcggactgatgcggatatccttggataaaatataatgtacattggtatatttttcactccagcgcagaatatccatgtcaaaatgatcctgatgtttgtggctggcaaacatatagatttttgtatccggtgcgtaatccggaatctttcccgtaaagtggaaaccattcacccggtccccgccaaaataatcaaaaatcaataccagatcatccacttccaccagaaaacagctgtgatgtataaaaattacctgcatgttgttccaatctcctttatcatctgtgttacaagcttttgaaataccggagccaccgcatcggctgcttcctgcacctccttatgtgacaatggctgtggcgaaatgccgcatgccagattcgagatacaggaaattcctacaatccgcatccccatatgatttgccgccacagcctcacatgccgtactcattcctacggcatctgctccgagtgtacgcgccattgccacctcctgtggagattcataggccggcccggtaaactgcagatacgttccctcttttaaatccgcccccgtctctgccgcacatttttttgcgattttctgtaaatcataatcataaatccggctcatatccggaaaccgcggtcccagttcctctatattttctccaatgagcggcgacggaacaaaacttgcaatctgcccggtaagaagcatcagatcccccgccttcatgcccagctggattccgcccgctgcatttgtcaaaaacagaacttctgcccccagaagtttcatcagccggatcggccgtaccacttccgtcatggaatatccttcataataatgcacacgtccctgcatgcacacaaccgacacatccccgacataaccaaacacaaagcgcccggtatgacccggcaccgtagataccggaaatccctcgatctcatgataatccaccgtggcctccacgcgaagctgcgacgcataatcacccagaccggaccccagtaccagtgccactttcggcacaaaatctgttttcgtcctcacgctgcgcacacagcgcatgagagtttcatattcgttgctcatttgttctccttattttttgcaattacatacagaatttcattaactaatagtataacagaatcaaaaataaaataaaacaagagcaactgaaattcatactttttttatttctcttaaataatgatgcagatcattcccccattgctgtcattgacaattttctgcatggtatcctgcagtttcagctgacattcatcatccatctgcaggatcttgctgcggatgccgtcttccatcagttccccgaccgattttccgaaaatatttgtcgtccagattccttccttgctctcctccccctcgcggatatatgcaatcagatcatttgcctgttcctcactgccgacaatcggtgctatttcggtctcaatgtctgccttgatcatatgaatggacggggaaattgcccgcattttcacgccatattttccggcatgctggatcagcaccggatcttccatccggatatccgaaagccccggcatgaccactccataccccttctgttccacagctgccatggcatcttccacacgctcgtattcttttttcatccgggagagggaacgcagcatggaaatcatctgatattccccttcgatctgcattcccgtcatctcactgatgtaggagaaatagcactgttccgttgtctccatccggatcgtcacgattccgttggaaagatctgccgtctgcagctggatgtcacgaaaaacttcttctcccatctgctcatttgcactttttacccattcctgcccggcaagcacagccgctgcatcccgcacgcggccgattccatccatcagtctggatgccgtctgaatcatggctgcctttaatttatgttccattggaagcatttccgtccacttcggaattgcaaagtccacacgggtaaccggaaattcaaacagaatcgccttcataactgtgaccagatcctcccggtgcatctgctgacagttgaccggaaccactaccgcctgatattcctgctctaaactttctttcagtgcaagtgtctcactgctgtatgggcgcacggaatttaaaacaatcacatacggttttccaatctctttaagcttttccaccgcggtttgttctgcctccacataattttcccgcggaagttccccgatactgccatccgttgtcaccacaataccaatggttgcatggtctttgattactttttctgttccaattctcgctgcatccgaaaaaggaatttcctcctcgaaccacggcgtatgtaccatgcggtatccgtccccctccagatgaccatttgctccctctaccataaacccgacacagtcaatcagacgcacactgacactgctctcatctgcaagtgtgatctctgctgcctcctgcggaataaatttcggttctgtcgtcatgatcgttttcccggcggctgactgaggcagttcatcgagcgtccgttttttttcttcctcatcttcgatgtacggaagtacaaacagatccataaaccgcttaatgaacgttgactttccggtgcggaccggtcctacgacaccaatgtagatttcgccgttcgttcttttctggatatctttatataaatcaaactccataaaaaaatctcccttctttgcatattcgattaatctatctaatctatatgcaaaggggagaattcttattcacagaaatactctgttgtatatttatttctcagatgacttctttttgtcggaagtcttcttctttgcagcttctttctctgctgctttctttgcctgctcagcaagcactttttcactgatgcgtccatacatctgcatgtatttatagagtttctttgccagatccttggtaatctgtccctccagggcacgccacttccagttttctccaagtgtggaaggaatgttaatacgggcttcggagccgagtccgatcaaatcctgcatcggaacaatcgccatatctgcaacggatgaccatgcggcacgcatcataccccagttatatccttcctcctcggtcagattcaggtactcggttgcgaacttgacagatgctttcggtgccgtcttcatccatcccatcacggtatcattatcatgtgttcctgtatacacaacacagtgactggtataggtgtgtggcagataatcacttccctcacggctgtcaaacgcaaactggatgactttcatgcccgggaatccggaatcctttaaaagtttgcggacggaatctgtcaaaaatccaagatcttccacaatgatcggaagcttgccaagtttcttctccagctggttaaacagatccattcccggaccctgtttccattttccgttctttgcagtcttatcttttgccggaattgcataataagaatcaaatccgcggaaatgatcgatgcggataatatcatacagctcgctcatcgctttgattcgtttggtccaccatgcatagttatcttttttcatttcatcccagcggaacagcggattgccccagagctgtccatctgccgaaaatccgtccggaggacatcctgccacttcaatcggatttaaatcttcatccagataaaactgtttcggatttgcccatacatccgcactgtctccggccacatagatcggcacatctccgataatctcgattccgttttcattggcatatgcctttaactctctccactgtttaaagaacagatactgaagcatcttataaaactcaatatcttctgcgtacttttttcttgcctcatccaatgccgctgcgtcacgcacacgaagtttctcatcccactcggcccatgcttttccgtcatttgcatcttttaatgccataaacagcgtataatcttccagccagtctttttccgcctcacaaaatgacgaaaaatcttccggcatattttttacaaaacgggcatatgctttatgcagcaatgcatagcgtgatacatacatggttccataatcaatgtattcctcgcttgtgccccagtcaaatgactcacattcctttttctttaataaattttccttgcagagaatgtccagatcgataaagtacggatttcccgcaaaactggaaaacgactgatacggtgaatctccgtaactggtcggacagatcggcagaatctgccagtaagtctgacctccttttaccagaaagtctacaaattttctggctgattttcccatagttccaatgccatacggtgatggcagggaagatatcggcataagtacgccacttgttctcataagtgattcctcctaagatccaatctataatctataattatatcataccacctttttgtccccttgtaaaaagcatttttcaatgctagtatgaaagaaagggattacgaggtgaagaattatgaacgatgtcataaaacataaaatcaaacacaatgcacaccgtgcactggtatctgtcaaatgggtaatttttgcaattcttgtcggcggtatcgtcgggctgtgcggcacggcattttacttttgcctgacatttgtcaccgtactgcgtggacagaatccgtggcttttatatctgctccctgtcgggggactgatcattgtcggtgcttaccatctgctgcgggacgaaaaagataccgggaccaatctggtcatctctgccatccactcggatgacgagctgcccctgcgcatggctcctttgatctttatttccacactgatcacgcacctgtttggcggatctgccggccgtgaaggtgccgccctgcagatgggtggcagtatcggaaacgcaatcggaaaattcttccgttttgacgataaagataaacatgtcatgatcatgtgcggcatgagtgctgcgttttccgctctctttggtaccccgatggctgctgccatccttccaatggaaattgtaagtgtcggcgtcatgtactataccgcccttgttccatgtgtgatcagttctcttgtcgcacacggagttgcttacctgtttggtgtttccaaccaatggttttccatcgagcacatcccggactttggcattcttcctgccgtgcagatttccatccttgccgtgctctgcgcactggtaagtattgttttttgtgttcttctgcacaaaagtgaagaaatttaccgcaaactgttccagaatccctacatccgcatctttgccggtggatgtattgttgtcattctgacgatgcttgtcggcaaccagaattacaacggtaccggtatcggcatcatccagatgtgcattgatggaacggtccgtccggaagccttcctgttaaagatgatctttaccgcactgactcttggtgccggttacaaaggcggagaaattgttccttcctttttcaccggcgcggcctttggctgcctgtttggaacgctgaccggcatatccccgacactttgtacggctgtcggcatgactgccgtattctgtggtgtcacaaactgtccgatcacttcactgttaatcagttttgaattgttcggttatgacggcatgccgtattttcttctggctgtcgctttcagctatatgctctccggatactttggtctgtaccggagccagaaaattgtgtactccaaatacaaaaccagttacatcaacaagacaactcactgattccaagaaccacacagccagtcgccggcaattccatgttcgaatgaaccgaaccgattggccgggttcctgcatgcaggtcatcaatatataacgtccatgtcctgtcatccggcagcaggagtgtttcttttctgccggatgcattgtatgccaccagaagtgtctcttccggctggcggattgtaaacgcgatggtctgttcggatgtcatttccataaacagaatattctggcggatctcctctgcgtctgtcatacgcaatcctttatgtgctttccggaaagcaatcagtcccctgtaatactgctgcagccctttttgtccatcgctccagtcatagcgcagtacatttgtttcatatggcagattataactgttctcggatatctcaccattttttccggctggtttggttcgtgcaaactcttctccccccaggaaaaacggaactccctgtgcggtaaataccatggcagccgccagacggttcattgcaaagcgttcgcctgcatcacaatccggtctggaaatctgcagtttatcccacaaggtcagattgtcgtgacaggaaacataattgatcactttctccggtgtatccgtccatgtgccgccgactgcataggtataagctgcataatctacctgtggatgccacacacctcctgttgcacagtaacgcaccgcaactttcattttttcctttccgctgacatagccgcagtctttgttataaaacacatgtccgcgcaccatgtcccggatatcatccgaaaacattccgatgccgtccagcatacgcgcgtttctcttcatggcacgcctaaattccggcatggttgaagtaccgcctgtccagccctctccatacagaatgatatatggattgatttcttttaacctgcggctgatctcattcatggtatcaatatcaagaacacccatcagatcaaaccggaacccatccacatgatattcccttgcccagtaacagacagattctacgatgtatttgcgcatcatcggctgctccgaagcaatttcattgccacaggcagatgcattggaatatctggttccgttcatccggtaataataatccggctcacatttctgcagacagctgtccagatcataggtgtgattgtacaccacatccatgatcactccgatgccctccctgtgaaaagccgcaatcatttctttcatttcccggatacgcacctccccatggaacggatctgttgaaaaagatccctccggtacgttataattcagcggatcgtatccccagttatactcccgcttctttggtgccgcctcatcaatacttgcaaaatcatacattggcatgatctgcacatgcgtaataccgagcgatttcagataatccagcccggtagcttctccctctttgtttttggttcccttttctgccagtcccagatactttcccggatattttaccccggaagagccatccgcggtactgtccagaacagaaatctcacagatcaccagatccgtacggtttgaaaaaaccggtccatgatcctccttaaaattctccggatcggtttcttttaggtccagcaccatactccgctgcccgttcacaccgacagctaccgaatatggatcctgtgactccacggtcttgccgcttctctccagacggtatgtataataaacatgccgcaaatctccgtctacccgaatcgtccaggttccctgtacatcccgtttcatcggaagtgtatccgacaggcagtccccgtctccttcccgatacagacacagtgttactgcatccgcagtcggagcccagagccggaacgctgtatatttctttgtgtacacagcacccagatcatttccatcatatggaatcctttgctgcattccctctctcctccctgaaatatatcattttcgctttttttcgtaattcattatattttaattttatgtatctgtaaattggaaaaatcactaagtttttttcaatattttgtgaaataagacgaagaaaaaagacattccatgttttatgccatgaaatgcctctttttttgttttccgtatcaggcaaacccttatgcgtttgttgcctgtaccattgcctcaagggttctgactgctgctcccgaatcgatcgtctttgctgcaagtgcaatgccatctgcaatactgtctgcctttttcccaatatacaaagcggctcctgcattcaaaagcacaatctccctctttggtccctgttcctttccggaaagaatatctctggtgatctgtgcgtttacagctccatccccaccctgcagttttgcgatttcacaccgctttaatccaaactgttccggtgtgattgtataggtggttacttttccgtccttaatttcagataccgtggtctcaccggtcagtgtgatctcatccatgttatcctctccgctgacaaccattccccgttctaccccgaggttcatcatggttcccgcaatcacttccgtaagtgccggggaatacacccctacaagcattgccctggcacgggatggattcgaaagcggtcctaaaatattaaacaccgtgcggatgcccagctgttttctgaccggtcccacatacttcatggcaggattaaaatgcggtgcaaacataaatccgatcccgaccgtctccacacacttttctaccacagccggatctgcggaaatatttacgccaagtgcttctaacacatctccggcaccacttttagaagaaatggaacgattgccatgttttgccaccggaagccctgctgctgccacaacgaacgctgatgttgtggaaatattaaacgaataggtacagtctccgccggtaccgacaaaatctacataatcctttaccttcggactgatcgtatttgccttgttgcgcaatacggctgccagtcccgtaatctcatccagcgtttcccctttcatgcggagtgctgtcagaaaacatgcaatctgcgcctctgttgcctgtccggtcagaatcagctcctgtgctttcatcgcttcctcttttgtcagatcttttccctctaccagtttggccagaatctctttcatctatgatatcctccttgttttattcgcttttccgtcacatttcatttaactcttttttgaatgtgctgcaatagtctgctgcagcctgcggatcaaaatcgtgcttccgcatcagtgtgataaaatgagagcctacaatggctccatcaataatctctttcatcggacgtacatcctccgccgtgcggataccaaatcccatcataaccggaatttttgcctctttctttaccgctgtcaggtattctaaaatctgacggtggaaggttgcttcctgtccggtaactcccatggaagacacacagtagacaaatccccgtgcatttttaaggatttttggcacacggtctttggataccggggaaaccagctggatcagaatggttccatcctctttctgtaactgtgtctggagttcttcctgctcttccagcggcagatccggaatgatcagtccatccaccccgcaggcattgcactcttttacaaatttttccacgccataatgcagtaccgtgttgtaatacatcataaatacaaccgggatctgcacaccatcggtccgcatctctttcatacaggtaaatgttttctccagatttgccccaccgagaattgcctcataggaagctgcctgaatgaccggaccgtctgccaccggatcggaaaacggaattccaagttcaataatgtccgttcctgccgcttcctgtgccttgatgatcgcctttgtcttatcataatccggcagacctgctgtgatataagtaataaatgccttttcttccttttcctgtaacgcctgaagcgctgtctcaattcgattcatccctgttatgccctccttaattcagatatccttttccgtcaagataatccgcaatggtgtttacatctttatctccgcgaccggacagacagataaccatgctctgatccatagtcatttcttttgcctttttaaatgcataggcaacggcatgtgcactctcaattgccggaataattccctctaacttacacagttccatcagcgcatccattgcctccacatccgtaattgccacatattttgcacgtccgatatcccgcagatatgcatgctccggtccgactcccggataatccagtccggcggaaatggagtgtgccagctggatatttccatcggtatcctgcaacagatacgaacgcatgccatgcaatactccaggctctcccaaagccatggcgctggcatgttttccggtctcaattccaaggcccgctgcttctacgccgatcagttccacctccggctcatcaataaaatcggcaaacattccgatggaattggaaccgccgcccacacatgccataaccacatccggattctttccttctgcttccatgtgctgacgctttgcctcccggctgatcacactctgaaactctttcaccatcttcggatacggatacggtcctaccgcagatccgataatatagaacgtatcctccgctgttttagcccaggtacggatggcttcgtttgtcgcgtcttttaaggtattgcttccggattccacggataccacttttgcaccaagcatctccatacgcatcacattcagtttctgtctctggatatcttcttttcccatgtacaccgtacattccatatcaaacagtgctgctcccgttgcagtagctacaccatgctgtcctgcaccggtctccgcgattacctttgtctttcccatacgctttgccagaaggatctgaccgatcacattgttgatcttgtgggcaccggtatggtttaaatcttcacgctttaaataaatttttgtaccgtattttgcagacagacgctctgcatagtaaagcggtgtctctctgccgacatactgtttcagataataatggtactgttttataaactctggatcatggattgcctcctcatatgcctgatccagttcctgtaatgtattcatcagcgactctgccacatactgtccgccaaactgtccataatatgctttcttattcatctttctttcctttcttttgcttcctctttgacacatgctacaaattgtttgatcaatgcttcatctttgccattttcattttccaccccggaactgacatccacaacatccggatgaaacagctggattcctttgttcacatttccggcatgtaagcctcctgctaaaacgaattttctcccggcaaaaatcccctctgtctggtgaaacgtctgcgtcttttgccagtcaaacgtctgtccgcctccgtaatttgctccatccaccacaagtgctgtaattttctgctgtaacttttccggcaaatccaaaaaatcttttgtcttttctgcaaactctttgggatctgacaggtttatggcataccagacgggaagttccactgccgaaagtgcctcggctgacagcgttccatgcatctggatgatatcaaatttcatctgttgcagtatttgaatctgtgctgcatccggagaaacagtcacggcaactttctttatatccggacggattttttccataattttttttgctttttgacagcttacattgcgtttgcttttttcataaaacacaaatcctgtataatcggcacctgcatcatttacatattgtgcatccactggcttttgaagtccgcagatctttacttttggtctcatgcctgatacagctccttccacttttgtgcaagcgcttttggattttccgattccataaatgcccgcccgatcaaaaaggcatctactccgcaatcgcgcagaaaacgtacatcttcatcccctgtaattccactttctgccacaaacaccttatcctctggcacataagggcgaagccgtctggtatgttctagagaaatcgtaaaatctttcagatttcgattattgactccaataatgcgcggattgattttcattgcccgctctacctctgcctcatcatgcgtttctaccagcacatcgagttcaagttctcttgccagctgataaaaatcatgcatctgtgcatcatccaaaattgccgtaatcaaaagtaccgcatccgctccgatcacttttgcctcataaaactgatactcacagatcataaaatctttccgtaaaatcggaagctgtgatttcgcccggatttcctttaaatattctacatttccgtgaaaatgatcttcttctgtcagacacgaaatggcatccacagatgcattgtattccgcgatccgctccgtcagatcaatcttgcttgtaattgttccaagacttggggatgctttcttaaattctccgataatagaaagtcccggtttctttaaatgattgtaaaagcaattggcttccctcgtctttgtctcctctgccatacggcgcatctgactttctgaaatgcgggccatatgttctggaagccgtctttttttgtctgctacaatttcttctaaaatcatatcgtatctcctaacacttttcgggaacatcggtccatataaagtttgccttcggcaaaggaccgacgctacatgttagatttccaaggaaatctaacacatatcatttacgaagttttctatgatgcgtttgccgtgttcggtataaatggattccggatggaactgtaatccgacaaccggatattccttatgacgcatagccatgatctcgccatcgtctgtccgtgccagcacccgcagacaatctggcagatctttttcctgtaccgcaagcgaatgataccttgccacacggatcggagaattgattcccgtaaatacgctgcttccatcatgctcaatcagtgactgtttgccatgaaacagtgcttttgcataagaaacggttccccctaatgcctcaccaatacactgatgtcccagacagataccaagaatcggtttctttccggtaaattcccggacaacatccatgcaaatgccagcctcttttggatttttcggtcctggagaaagcacgatccgctccgggtccatcgcagtaatttcatcaatggtaatcttgtcgtttcggacaactttgatatcggagttaaaaattccgatatactgatacaggttataagtaaaagaatcatagttatcaatcagcaaaatcataaattttcctcctcaatcagtgtctttgccagtgccattactttattgcagcactcctggtactcattttccggaacagaatctgcaacaattcccgctcctgcctgcaaatatacccggtttttctttttgatcattgtccggatcgtgatacaaaaatccatgtcaccggagaaatcgatgtatccggttgcgcctccgtagagtcctctgcgcacactctcaagttcatcgataatctccatcgcgcggatcttcggtgctccggaaagcgttccagccggaaggaacgaagaaaccagatccagcggatgaaattctccttttttctttccttccaccatggatacgatgtgcattacatgggaataattctgcacttccataagctgtgtcaccttgacggttccaaattctgagatccgtcccatgtcatttctcgcaagatccaccagcataacatgttcggcgcgttccttttcatcccggagcaattcatcccgaagcaatgcatcctcctcggcatccacacccctgcgccgggttccggcgatcggacaggtatacaccctgcttccctgctgctttacaatcatttccggggaacttccgatcacttcaaactctccataattgaaataatacagatacggggatggattcagttcccggagctctttatacagctcaaatccggtctgttttgtctcaatcgtccatctctgggaaagcacggtctggaaaatatgtccttcccggatatactgcttgatcttttcgactttttcgcaatactgttctaaggtatcggactggttgacaatcacaccgtcatgtgtaaaatttctgtccggtatctgtccggcattttttcttgcctcctcaatcagttctgctgcttctgctaatgctttcttttttccgtcttccgaatcttctccaagaatcactgcggtcagcgtctctgccacgtgatccaccaggataaattttgtcatgagcatcatctggatggtctcgattccaatctcgtctggattgttatccggcagtacttccgcatagcggacaaaatcatatcccagatttccgaccagtcctccggaaaaagacagctcttcgttttcttttacgatatcaaactcgctgtaatattctttcagacgttcgagcggatttccctgccggatttcttccgtcccgttgttttgccggatcacgagtgcatccccgcgggaagtaatgatctcttccggttcttttccaaaaaacgtatatctgtcataatttttatcataactttccagaagaaatccttttttgtttcctaccagactctcatacatgccgatcgctgtttcatttacaatgctgactgtctttttgtatacccgtaatctccgcttcatattactgctccttttttccaaataaaaaacgtccctggtccgactgctgccggatcagggacgattatcctcgtggtgccacccttcttcgctccgtaactgaaaactaacaaaggcagccatccccgaaccggaaataactgccaccaattacgcaacctcttgtgatacagaaaacaaaatctttttgtctcgatatccatgcccctgtaacgtggggaaacggctcaactactcgccttacgctttcaccttgcatctaacgaatccattccatgacaaactatcctgccggctcacacctgccgccggctctctgaaaggaatcatctgctgtacttaccttcgctcaatgattttatttctctttaatttattaacagtttaatacactacagtgtgtctgtcaaccaaaactttaactttcaggaaaatttcattttaggatacaatcaccttgcggaattttatattttctttttcactcttttcgtgtaaaatacattttacggcaatgtttattgcataacaacttaagaaaggacttatagctatgaaacaaaaaataggactgtttctttgccttgccctgctccttaccggatgcagctaccagacaaagaccatccgtttcggtgcagccgacatcggtgggatgtattataccgttgcaaatgcttatgccggtctggcatccgaagaatcctccgacctgaaatttgaagttaaaaacaccgccggatctgccgcgaatctgcggcttctgtccggaaattacattgatcttggaatcgcgcaggcggatctggtccgggctgcctacgagggaaccggcagtttctctgataacaggcagcagggataccgtgccattgcaggtctctacaccgaagcctgccagatcgtcgtccgggcagattctgatatccggacattaaatgatctgcagggaaaaaccgtcagcatcggtgccagcgaatccggaaccgaacaaaacgctaccgaaattttaaaactgagtggtctgacttcgaaactggtgcacatggtaaatctggattatgcagatgcagcaggaaaacttgcctctggcgaaattgacgccttattctgcaccgccggcatccgcactgctgtcatcgaagaactggcaaaggaatgtgatctgcggctcctttccatcgatgatacctgtctggaaaaattgcttgcaaccacaaaggaataccgtaaatatatcattcctgcaaacacttacagtggacaaaacgaagacgtgacaaccattggagtcaaagccgtactgcttgcctccgatgatctgtccgaaaaaaccgtggaaaagcttacggaaattctgttttcccacgcacaggatcttgcctatgccacatctttagacgctgcttttgacgagacagatgcatcctccggtgtaaccattcccttccatccgggtgctgctgcttattatgccaagcagggaatcagcgtcaatacaaaataacatatgaaagaaggacaactatggaaatacatttgaatatgtaccagacgctggcagtcgctgtactggtactcttgtttggcagctttttaagacaccgcattgggtttctggaaaaattctgtattccggcacctgtcattggcggtcttttgtttgcaattttgacctgtctttgttatgttaccggaattgtggaattttcttttgacgacacgctccgggaagtgtgcatggtatttttctttacctctgtgggattccaggcaaatctgaaagttttaaaaagcggaggaaaagccatggtcgttttcctcggtcttgttattacactcattgtctgtcagaaccttctcgcagtaggactgtcccatgtcctgcacttaaatccactgatcggtatgtgcaccggctccatcccaatggtcggcggtcatggtactgccggagcattcggtcctgtcttagaagactttaatattcagggagccaccacgatctgtactgctgctgccacctttggtctgattgccggcagtctggtcggcggtccgctcggcagacgcctgattgaaaaacagaacctgctgtccacggcagtcacggaagatgacagtctgctggttgaggacgaaaagaagcatgagcgccatacaaatatgtatgcatccgccgtatttcagttaatccttgcgatcggtctgggaactattttctcctattttctgaccaaaaccgggcttacctttccggtttacatcggtgccatgctggcagccgcattgatccgcaacattgccgaatactctggcaaagcaacgatccatatgggtgagatcaacgacctcggtggtatttgtctttccctctttttgggtatggcaatgatcaccttaaaactctgggaacttgcttccctggcacttccgcttgtgatcctgctgaccgcacaggtcttactgatctgtgtatttacttacttcatcgagtttaacattatgggacgggattacgatgctgctgtactggttgccggaacctgtggttttggtatgggtgccacaccaaacgccatggcaaacatgcaggccatctgtgaccgctatgtaccttccgtaaaagcgtatctcctgattcccctgatcggaagtttatttgcggattttatcaacagccttgtaattaccttttttatcaatattttgtaattgggaggacaacgaaaatgttttggaaaaaattaaagaaaaaggcagctgaaaagcataattacgatctgacctacgacaatgtagcgattccggaagtgcacacccacaaaccggaagatcacgaagaaactccgggtgaagatgccccggtgcactatgacaatgtagcgattccggaggtacatatccgcaggaaaaaataaaaggctccgcagaatcaaatccctgagggttccggttctgcggagtttttcttttcctgtcatttattttaaatgcagacgttcttcctttccctgaatctgcagcgtcaccgggcgttccacatgtacgcattctccctgttctaacgttcctatcacgttgtcttctttcagcagtaaaatcttctccggagaatcactgatcatccggtatgtctgtttcgaagggtcataggaaatctgacaatgtttccactcgaatgttttgtttcctgctgtattcttcttttttgtggaagaatcctctttccggctgcgtttctttttcgactttctccgccggtgagcttttttgcgccgccagccgtgtccggactgcttcggattcttttccctttttatctgctcatttccctgtttttcgggtggccggtaccctcctgtaatccatcctgtcagtatgagtatccatgcgactccatgcagcagggtaaagaaatatatccctgacaacagaaacggatacagtgccggaaacacagccaaaacaatcagcagttctgccagcaccagactggtaaacagcgttggcagcagcatcgtcttttttccttccgccagaaacaacattcccacagacaaaaaacaaagcagtaccgggagcagtgctgcaatggcacaaactgccagaagccgcatctgtcccactccctgtacataagaaagactgctttttaccgtaccaaccgtgatcggagcttttaaaacgaaagtatctgccactctgccttctgtcagatacgtataacctgcccttcctcctgctttcaccacatccagaccggacagcgtcatctcctgcccgcctgccgaaaacttacaaaacggcaatagcatggaaagtaatgccagaagaagtgctattgctgctatatttttcaataaacgtccatacgttctcatgctcatttcctcccatcgttttacattctgacaggctcattatagcacggaatcttttgtcttcttattaaatttcttttaaatttttgtgattcacaattgccacccagattcccggggctttcaacagcaccgaaaggatataggccagcacaacacgcagccccagagagatcaccgtaagtaccactgacatctgtgctttgttgattgcccggtaatatccgtacagcagaaacagacacccgattccacagtaaaacgagccctcgatacgcagatactgcacaccacacgcgatgaccgccgtctcctgtgccttcacaaaaatctccatcagagatgctgcaaacgtgcacaccgaatggaaataatgatactgaatacaatactgatcgcaaaggcttccttcgttcccttttggatccgtccgtaatctttcaccccataattctgtgcgacaaacgtggaatacgcattgccgaaatcctgtaccggaagatatgcaaatgtgtcaattttgaccgctgccgcaaatgccgccatcgttgttgccccgaaactgtttacaagcccctgcaccatcagaattccaaaattcatgaccgactgctgcatctcctccatgacttcctgtggcacacgtagaaaccacagaataggatgcatacacacatacaccagcacgttaacgaagaccatcactgccatgatcagcacaaaagcatgcgccacagctacccgcgcgcatgcttatcgtttttccctttataaatggaaaataagactcctgcccccatggaaagtcccagaaaaatcgaggtcagaaaggtcataagtgtataggcgggccccaccgccgcgagtgcattctttccaaccacgcgcccgacaatcagtgtatccgcaatattgtaaaactgttgcatcagattgcccgccatcatcggcagtgcaaataagataagattttttgatatttttccttttgttaaatcatagtacattcttttattccgtgatgatttccccaacactgctttccatttcgtccttttccagaagcatctgctgcgcccgcttatcctctgcgattgctgtcatgatacggttgatatcctccggacagaacatcgtaattgcctgtgacaggtcactgagattatcccggttgaccatcagacacccgccaccttttaagctgatgttcagacacttgctacggtcggtgacatccccgagtgtaatccgatttctgtccgtatcacatacaaacgtaacccctttgtacgtgattgtaccgttttgtgccagatgctgatacggcgctttcttttcggttccgtctatatgctcccgaaaactacttccgcgcgtttgtccgttttgtgtacccagtcctgctacttttccgtataatgtattgtatcctgtctgtaatgctccaattgccatattctttttatcctccgtaagttacatcctgttttttataccagtccatggcccggtaaaaatccgatttttcataatcgggccacaatttttcttccacataaaagtctgcgtaaaccgactgcaccggcaaaaaaccggagagccgccgcatgccgccccagcggatcaccatatcaattcgcgaaatatccgaagaatgcaaaaaacccgcgctttttatgttggacagatcccatttccaaccataatttacaagaaaattcagccggataccacctccgtttatcgcagttcgatttgtatacttctttaattcttccggaaaacattttgaatcggtattcccgatcacgagcagatccaccccctctgtggcaagatcatgcaccgcctgcacacacgcctgctgaaaggcctgcacctgttctttcggacgcctgcaattgtcaacggtaaacccataatatgtgatttcctgaattccatacgtttttgcctgctgtaaaagaagcagccccggttttagtccgtatgcataaccggcttctctggataatttatgctgctctgcccatctgcggtttccgtccggtatgattccgatatgcattggttttctgtttttcatgcttttcacctctggaaaataattcccgaatttgcatgtatttatacattttcccagcttttatttttgtaatgtatttatccagttacataccacaggcatatatatttttcgcccgagatatagcacaaaaaacaccagtatcaccgtaagtattctccgaagcggccagtaccaaggctgttttccaagaaagcctttcagaatccaaattcccattttcgcttcttttttctgattgcaccgcatacaggcagtacataagtttttcatatcattcgaaccgtgaattccaaacaatgcggctcttctacgcactgccggatactcctccatgcaatgaaccggaaaaatatggtcaatcgttattttatcttttggcttctttttcccacagtatgcacaccggtattttccggtaggtgatggatactttgcaaaaaaaaggctacggtaattgctgcttcgcgtatactgcgttggcactgcttcaaatgtaagattccttcttctgcaataacgctgcatatgatttttttcccatctggaacattcctttttttcataatatactctgctattttcccgcctgatacaggtatatttcttccaccacagaaaaatgcggcagcgctttacgctttttgttccattttttattcttacggtatatgtctgtgccaatgttgcaatttcctttatttcaatttttgcttttacagcttataatccacatgttgtcccatgagcttctcgcgatccgtccggacttcattactcctctctacaaatgtatattcacctattttatccataagctcttctacagaattggcagttaatgtaatggtctgtgtatcatcctcacgctcagtcctggattctttggatttctccaggcgttccttctcctgctttttctctgcctttttctccgctgctttcttttccgccttctttttctccgcagacttttgaattctggatttctgatccgacgatgattttctgagcactgcaaaaaacgaagtggttccaccatcattcacctgcatgccatactcctttacatcagcaccggatttttccacgctggattttaactgttgcagctgtgctgttgctccactgagaattccctcgtatttcttacgataactctcatccatagccattcgttcaattttctcttcatcaataagaacgactgtcttaatattatttgcatattttgcggcatttgcctgagcatttgctttctgatctttgcttaccagaataaaatcataatttccgtatttcttttttaatttttcataatacttttgcgcttctttcgaaagttttggatcaccaatcgtctttcccaaatctttggattccgttaccttctcttctttctttacttcccctgtttccgtattcctggctactttcgttttttccttactgcccggtgtataattttgagcatatacatttgaaactattgtgtttgtattaactgccataacccttcctcctatcacaagatcaacatcattgtgccagcccctgcatctgcactgctactaatacaagtatcgtcacatctttcaaaaactttatacatcgaatatgttgatccggcatatatgcaatattcagaaatttttcagcagaaatccacgaattgtctgcacataatcctctactttcaggactgtcgaaaggtgcccacccgaaacatatttgatggttggattatgcatcagctgaatgagatctttctgcattttaccggaaaagaaatcctaatccggaagtatcagtaatattttgccttccagttccttaaaaatagtttcaaacatctcctgtgcatacgcaatttcttctttactttcattgcggatatgtcccattcctgccctgatcagtttcggttttaatttttcataattgcaatgtttcatataaaacagcataagcgatgcaagaaaatatttcttcttaaggcttttaagcgtagccgcatccatcccaccggttgaaatcagaatgattccgccaacttctttcggatacttctgtatatagatctgtacaaccatacctccgtcacttgcaccaacaaaaattggctgtgttactccgatcctgtcaaaaattatatttacaaaatatatgaaatttaaaaagacggctcttccgtttgattgaagctcgtaaaaatggtgggcgatttatcgaccaccacaaaaaaatcaaaaaatttacacactttacttgacaaactcaaaagggatatattctattttctattttctatctctcatcttattctttaattcctgaaccacttccagataatctctgtgtttcatatccggaaaagccttgatcagccgtccctgtcccacaaacgtatgctctacgattgagctggataactcatcaaattctttctgtagatctgccttatttttgcgaagcgtctcaatggatttatttactttctcttccgttgcttccttaaactctgccctggccaaagccgcctgcaccttaccttcgccaactttctgtacggtatcaatcgtcgttgttgccagagaatcactgatcttatcactgatcacccgcatgttggcacgaattgtatccagcctcgtaagtttcctgttcagtccctgaataaccgcaacggtcactataagatccgacagatacaatgcataaagtatggcaacgaccatccaccccacaatggatggcgcgtgcgcagaagtgtgatgttccacaaaagactgaaatactttcacaacaagcagaatcgccactccccagatcaatgagaactccagacagatatatccatgaaaattcaatggcttgttggaataatcccaccatcttgcatgaaagcaaacgtcgaggagccatccggcgatcagttcaaccgcagttgccaaaatcacaccaaacaggaaaatcataccgtcattcagctggtatccgctgccctgaaacgtattcatcatcgcaaataccgaaagcactccaaatccgtataccggacacacgggtccatttaggaatcctctgttaattacttttccacaggctaccgcatgatagacaacttcaagtgcccagcctccaaatgaatagatcaaaaaataccagcatatctggtaatatgtcattccacaaatcatcttttattccccttattctaatattccatgtgaataaaacagctctcatatgatagctaaatgccgtattcgatgatttctttgcatcttctgtctgttccgataccagttctatcaaattttccacttccaaaataatcacctgctattttctataactgctctgcaatctgcggaaacagaaggttcaaatccaatgtccgcacccatatcgtgttgccatccatagaatacttattattcggtgttatttgttcctgtgtctttgcatatagtaacattcctgcaacatttccggtttgatttctatccagatttttcacatacgcaaatatctgatacaaatttgccgaatgaatgctgttaacatcatactgtgtctgcattgtatacccataatactttgcatcaataatcagtactttgccggcagatttcaatgtaatatctgttaccatgcctggcaggaaatcaatcatcccatcgtctatattccacggaattgtatcaggatttgccttatactccgggtgatgataacgaaaatattccagaataaacttttcatataaactgtgcatagaacgttcatccaaaaaaactgccagcttcgtttcacctttatctgttgacagtaacaaactgccaagcaccagataacaaatattcataagcatccggtaactttgattgttacgctggtagcgaatcctgtcccatcgtatctgatccggttctattatatctacgttttcaaacaaaatcagatttttcttcaaaagaacttttctatccgggttcacagttttctgccgtaccaatatcatcatggtagttttcaaaatgcggttcagaagattattttcagatagttcatcatattcacatgccagcttttgcctatgttgtattctgttttttatcgttccctgaagattaagtttacctcttaaaacggacaattcttctgattgaagaatatattccttatacaatccctgtttaagctgatttgccactcctttgccgagtattgcagcaaacatgtcatgaatattctcaaagtcctctgtagccaccgaatcataatttgactgacgcagggactgaaatgcataggtcagcatataatatatattttttattaaaatccctttgtcattagtcattaaacacccctcttaaaatattctgccacttttgaatttttgcaggttcgtcaaaccagtattcctcaagcataggtaaaatatcatactcaaccacagactgcatccattcatctgtacattcatcctgcccacagaaataactatgcccgatgcagaatccagaacccaaagaaggatcttttgctatctcaaaattgagatcctttattttttcaatcaaggcataaaatgtatcatcattaaagctgtccaaatactgcctgaatccatcagaactaaatcccggctccatagcaaaaaagctgaatcttctacgcaaagcataatcaataagtgcaaggcttcgatctgccgtgttcatcattcctataatataaacgtttttaggaactgaaaatggcaaaccattatatgccaatgtcagcttttttcctctgtagtctttttcgataagcatcaatagttccccaaaaatcttgctcatatttccacggttgatttcatcaattatgaaaaaatatggcacttcttgattgtttgatgctttctggcagaatttgtaaaagataccattctgaagttcaaatccctccccggacggtttatatcccataataaaatcttcataagaataattctgatgaaactgaataaattctacccgtgattcatccttaacacccataatggaataggcaagcctttttgctgcaaatgtttttcccactcccggtgctccctgcaaaataatattctttttgttaagaagtaaacctttcaatgaatcatatttttcagaagtcatatatacttctgaaagaaattcctctttactataagactctgcttgttcactaccaatcggattctcttgattttcctcacgcaccatatccatgataaaatcatattctcctttggtcagcttaaagagacttccctgtggattcataaaatattccattttctccagttccggagcatctttcaacagcgtgtaatctatcggagatgttaatccctctatcttttcaaaatacagattttcgccatcattttgtttggtaacacgacagattgccacaacctgctttaccggatttgattcatatccgataatcagatcaccttctctggcatcaaggaaattctgaaaaattcgtcttttatttccattgtcattgtacatcgtataattctgttcttcgccaacctcaatgtccgaaaaactccatatcttcgggtttgcattcagccaccaataattaacgctgttttccgattgatctgcatataactcggtatcagaaaaatctacatcctctaacgcttccttcaattcgtcccgcagtttccagacaaatacaccatcttcatcagaatttgcattcctaccaacaaacaaaatcatccaatatctcttgctgccatccttctccttcacaggaatatcacaacctgtcttttcaacaattctttttgccaatgctgttgcaccggtattgtagaaattaggtgtttctccatattttaccgaaagttgcttacaggttgctattcctccataatcaaggaatctgtacattacttcccagctttgcgtattgaaaatactctcatcatcaaacagttctctccaatcatctgctgagattccaaaatctatgtccgcacctgtccagtcttctttcgccttctttgttttatcagccagataatttgcgatgtaaaacgataagtcaaaagtgagcattctgtggctttcgtctgcataacagtcagaatcaaggttattttcaaataactctatcagctcgctatcctgcgaaactacttcctgcatctcactaattaactttgaattgccttttatattctgctccgtatgccccttggttggtataaaatcattttccagataaattccggttgccttacatacagtatatttgaaaatatcgtatttctgcggatacttcaggcataaatacactgtaattgccatagggcgctgataatgctgatatcctggagataatctgtcacacaagtcctgcgccgaagattgaaattgcaatatacgctctgtaacatcttttgattcatcatagaggttgataaacattgctcttactgcttctgcatcatcctgtgcgtactgaatcatcatttttcttggaaaattgttcatagatgccagtaaattagcagttttctcagttgccttagcaaacatatctgcaaagtcattcgcattgatgtcccaatgatcctgaaaccatttcaccgcttcccatttatatttttccccctgccatctttcatcaaaaatcttcttatattccacaagcgcattttgcaatttctccagatttatcattatataacactcccttttctcttttacacaattatttaactcttgccagcttatgccatccatgtttatttcatcagatactatagacttgatacgacattcattggatttccctccataaatttctttatattgtcatccagaatcgaaaccagccgctgtcttgtcaataagtgcacctcttgagctattaacgataaacgctgatggcttcataagcgacagggtttctttgttgatcatatgttttgtactttttgtcaatggacaatgcatggaaacataatcactattatttcaatcttgttttatttccacattttgggcaagggatttttatggcggttactaataatatcagagaaatccgggaacagcgtggcatttaccaggatgaccttgccgctgctatcggatacagcaccaaaactgtcggcaggatagaacgtggggacagcaccccatctgccgaatttatgctgcggatatcaaagtactttaatatgctggtcgaagatgtattccatgtggaagattgagctgggtattttatccagctcaatcttccgctccctgtaaatgagaatttgtccgctcctttatataaaataattccatttttcagaactactaactatttttcttatctaaatgacattgattatctaattaactacattattttctgtctaaaatatccataaattcgtcacctgtaattgtttccttctcatacaggtacatagccagttcgtccagtttttccctgttttcagaaaggatttttcttgctttttcatgctctgcttttacgagctgcacgactttttcatcaatttccttctgtgtatctgcagaacaggaaagagacgtatcgccgccaagatactggttggtcacgttttccattgccaccatgtcgaattcatctgtcatgccgtagcgggtgatcatcgctcttgcaatttttgttgcctgttcgatatcattggaggctccggtcgtgatctcaccaaatacgatctcctctgccgcacgtccgcctgtaaatgtagcaatcttattctcaagttcttttttcgtcatcagatatttatcaccctgctcaacctgcatagtgtagccgagtgcacctgaggtacgtgggatgatcgtaatcttctggaccggagctgaatgactctgcaatgcagctaccagagcgtgtcctatctcatgatatgcaacaaccttcttctcctgatctgaaagaaccgcattcttcttctgatatcctgcaataaccacttctatactttcttcgagatcagattcatttacaacggtccttccactacggacagcacgtaatgctgcttcatttataatattagcaagctccgcaccggatgcacccgatgccatacgtgcaatcgtatgcaggtcaacatcatcagatgcttttatcttcttggcatgaacctttaaaattgcttcacggcctgcaagatccggcagttcaaccggcacacgtctgtcaaaacgtcccggacgtgtaagtgccggatctaacgactccggacggttcgttgcagcaagaatgatgacaccattatttccttcaaatccgtccatctctgtaagaagctggtttaaggtctgctccctctcatcatttccgcccatttgtccgtcacgctttttaccaatggcatcaatttcatcaataaacacgatacatggtgccttttcctttgcctgtccgaaaagatctcgaactttggaagctcccataccgacaaacatctcaacaaattctgatccggacattgagaaaaatggtacatttgattcacccgccactgcttttgcaagcattgttttgccggttcccggaggtcctacaagaaggacaccttttggcatagacgcacctacatcggtatacttcttcggattgtgaagataatcaacgatctctgaaaggttttctttcgcctcatcttctcctgcaacgtctgaaaaacggattccctcactggattgcacataaatcttcgcattgctttttcccattccaaaagccatcgaattttttcctccggcatgctccatcagtttcttcgccatataatttcccagtgcgataaaaaggatcaatggcaaaacccctgtcagcaggaagctgatgatcggtgacatctgcttatcgatatcttttgcgaatactgctccacatccatatagcctgtccgtcaggttcggatcgttcatcagacctgttttataaatatttttttgatctttatctgtaaagatgatctgattgtccttaacttctacttcaccgatattcttcttctcgatcatgctcataaaagttccataatccgtttcctttacctgatgctccataaggattggtgtgacaaccagattaaatacgatcagcactattaacacaatcccataataatatgccagtggttttttcggtgttttaacttctttcatggtctttcctcctgttgttctgcgatatgctttctccgtgcattttcgtattatttattctgccatctgacttcgcccttggacagaagcggataacagatcagctgatctgaatccagattttccgcatgcatgtcaaccgctgtgatctgatgattatcataagtcgtataataataaataccttttgctgtattacaacaggacgtgtatatcgtgatctcatatttgccttctgtcacctcacaacatccacgctgctgatctacagatcctaagatatggaagaactggcttacactctcaccctcttcttcaccggagatcgaatttaattttgtaaaggcaactttcacaaatcttgactggctggaaagatctccaggtattcccattccacccattcctctgctatatgcatcaagctgtaatactcctgcaaaagtactctccggctgttttctggatactccggcataattattcagtgcaaacatctgactcgggaatggtggattattggtaagcactcctaccggattatcatatacatgcagcccatccttcatagactcaacaacgatacaggagtctttgtctgcaatgatccagtgaagctgtgctgtcggcagctgttcactgaatgctgtgcctgtcagtctcattgctgccagcttctctctcgcctctgctacagtagcacactgtgcaaggatccatgggatgaactcgaactgtgccacctggctgacttctgtttcatcttccggcaaagcctcttcatatgccgcattgccgacaaaattaagacctgccattccaaggcctttttcattaacagcatcataataaagcggataacctcctgcaacaaatgccattccgatcaaagcataatggctttttatcttcccggcaaaccggaaatcaaattcgtaatttcttggcgttatcgtgatctgttccccataggaaaattcataatcaagcgttctgcccatataaaaatcttttgttttgtaagttgctgctgtacacatatcgaacacctcttctttctgctataatagtcctgcaaacaatctcataaacaactgtccgatccgtaaatatgcactccgtcctgtgcggtacttttcggtcacttccctgcattcattcatggttgctccaagatcatctcttatatccaaaactgtctgactaccattatactgcattataaggcagataagcaatctgtctttttgtcataaaaaaacttatctaaatgacattgaatgatttattttctatctaaaattttattaaaccgactaaagactccatagtttgtgtgtttgacttactgtttatatctatcttctcctaaatatttttctagtcattgcaatataaaattgtttatacagtctctcccttaagagtcctggtattctggataatatacagagcgaccgatatgaccatcattatagcgcacaaaccaatcaacagatctgataccatcggtgtaatgtggaaccatataatatgcaccgctgcagttccatataataaaaaggttactatctttccatgccagtctgcaccatgtacttttcctgtctttcgtatcacaagacatccactgactaccatatacagctccttacctgccattattacgattaaaagaagcatatgcggaaaacgagtaaacagacagattaacatcgctgcctgtgtcagcttatcagccaccggatcaagtatttttcctaaattactaatcctatggaatcttcttgcgatatatccatcagcaagatccgtaagaccagacagcaataagatttcaccagctaacagaggatttttctttacacaataactccatataattaccggaatcagacaaagccgaaaaaaagaaagaagattaggaaccgtaataattctattcaaattttcttcctgattcacttcactctgcatgtacgatcacatcactttccttttttttagacataaaccaataaaatataacacaaaatgctaaagcaaacacaacaccaaaaacattttgaatcactctaagactaaccgctccttgtagtccataagtctctgcagcaatggctaaagcaccaaatgtgttaaatactgcctgccagccatattgtgctgaaaatcctacaccgattccaccaagaattcctatatatgcatagattgacgaaggaagcagaaaatataatactgtaaaacatataacacctgcaatatttccgacaatccttttacggactctgtagtgcatatcttccataaacggcaaaatcgcggacatggccgcaataccagcccacattgcacgtggcatattacaaagttctgcaatgcaaaggacgatcggtacgcataaaatctgacatatctgccattttgttctggaagaagtgatatcaaattcttgtatcagatctttcagatttcttttataagttctgtttttatgatttcgataaaatacgaagcaggtaagtgctgcacctaaagccattccgactaatcgcatctgatagctttttcccgtaacatcataaccatatagcagcagatacccaagaaccaatgtagattgattaaacatgaatggattatggcatccgaacagaatcaacacagccagtgccgcaatatttaacagcattcccaataccggtgaaaactgatttgctaaatgcggacatacagtcataattacaaagaacaaagccaaaagcatcgtagattgtccggtgtggatccccagatccgcattccgaaataccataaggcataataaaactactacacccacaatactattctcatttccaaataagatactgaaaatagtaacaaataaaaaacaaaatgccattgtaacagctatctttaccaaatataccagtatatgatatgatttttcttttactgtttcactctttttcaacagatttttagaacctgcctgatttaactgcaattcctgataaaatgtcatgtaattcctcctctatctgtttttcttaaacttatatggcctcatctttctgtattggaagctctacaacaaatctgcatccaccatattcacggttttctgctttgattgttcctccggcactatctacaatccgttttacaagtgcaagacctaggccatttccttctgctttatgagatccatctacctgatagaacttgtcaaatattctggattttacatcatcctctattcctggtccttcatcttccagaatgaacttaacagaatcctgttcttgtttcagaaacatcgtaattgtcccctttgaagggctgaacttaatcgcattatccaaaagatttatccagatatgcataaaaagtccttcattcccagtatatttaacttcctccaattctacctgaaaaccaatttctttttctgtccattttgtttccaatgaaagaaatgcctggcggatctgttcatccagacgatattctgtttttttcattggtatattctgattctctaacttggataacagcaaaatattaccaaccaatccggaaagtctttgggtgttaaataagattttttctacatattcctcttgatccggagacagttcttctccctgaagcagcattgtatatccttcaatggcattaatcggggtcttaaactcatgagaaacattagatacaaaatccatctgcagcacctctgttgcacgaagttcttttgtcataacgttaaaactttgataagattctccaacttctgctatacggctgttcgtttccaaatgctgttcaaaatctccccgagaaacttccttcattgctttactaagcctagtaattggttccagtaactttgcattaataaaggaagtgatcagccctgcaatcaatgtattgaaaatcaaaagccagccaagcacaggtatgctgcccggcagattaaaaaaatgattcaaaaaagcaaataataaagcagatataactgttgaaaatacaagtgccagccagattgcaccagtcagacaggatcggatccgcaatcctttttctttcttttgttccattattttttcaccaccttgtatccaattccacgcattgttacaatttcaaaatcagggttatctttaaaacgctctctgattcttcctatatgtacctctatcgtatgtgggtctgcctccgtctcgtatccccatacttcatccatcaactgttgttttgtaaatgttctgcctggcgaagttgcaagcttatataaaagcaggaattcttttttaggcaaaacaagactttccttatcagttataaccgtcattgcatcataatcaaactctgttgaaccgatcacaattttgtgttcattcagtatctgtgcacggcgaagcagtgctccgactcttaaaaccatttcattcacatttaccggttttaccatataatcgtcacttcccgaaagaaatccctggcgcatatcatcaaaggaacctttcgcagtgatcataagcactggtatctgatatcctgctgaacgaagttctgacaccagttcatagccatccataaccggcatcataatatcagaaataatcagatcaatatattccttatccaatacttctaatgcctgtgttccatccgatgcacttttgacttgatatccattcttctcaagcactttttggaatagctggcttaattctttatcatcttctacaatcaatatttgaaacacgttttccttcctccttattaaaacagataccttgcccatccaagcagatgctgtaccaaaaatatttttctctgacgtttctttgttaattcgattggctctacatgatatggatcacgataggttccatcttccaatacctggcgggacactctttcatattccatcatgccctcttccaactgtttattaatatctttactgcgaattacaagcatcagttccgtatccagatatgcacttctcatgtccatattaaaggaaccgattacagacagatcatcgtcaatcagaatactttttccgtggtatgaataaccgccttcatattcccagatattaattcctgtacttaagattctatttctgtttttcgcataatcggcagccccaaatggattcccattattcgcaactgaatttgtcataatagaaaaatctgaaacgttctctgcaatctcctcccatgtattatacatcatatcattacagataatatatggcgtgtggatcttcacacgattttttgcatttttcatcaattctcccaactgataccacactactggttctttggaacctgtgtgaataggatttgacactaatgcaatcttttctgtctcaaaagtttcgtccgtgtaatcggtatcacagattctttccttattctcttcaaaatatttctgatagccgttctgcagctctaaaactgcgttctttacagattttctatttgccagttttttattgtcatgaaaataaccactgtcttcttgttcccatatcgtttcaaaatactctaacaactggttaactgaattttctttctcaggttcatcgcaaactactaacacgtctctgtcatagttcttatgtcccggaaaatcacccaggaaataattgtatgtatttcttcccccaagaatatatctctttccatctgcaatcaaatatttatcatgcattctacccatcatcttccatggtttcaacggattggccttattatacagtttaatttcaacattctcatgggaagataatccatagaaatacggatttccttccatatcaatccagctctccattccatctactaacagacgaatatgtacacctctgtctgccgcatcatgcagtgctcctaaaatcaattttccactttcatcggattgaaatgcaaaagtagaaagaataatttccttttttgcattctggatcaaacgcactctttgtaaaagcgcttctggattcttttctatgatcactgcccgttccgtattttcactgcattcgttccatgacccattttttgtttcttttttggttgtattggacacttccggctgctttttatatgcaatgcagattccgagtaattcataaaaagccacacataataaaattgccagtataacaagaaggattttacatatcttatgctttttcattgtatatcacctgattccttttcatttcatacttatacaatacaaagtcaatctcaatttaacctcaacaaaatttatttttcataaaaaaaatatgacaggcttctttttaaagaaacagtcatatttttattctaatatatgaaggagcttttcttactccgttgtattaatcactattttatttcttccataagctgtcggatttttctcaatgtacaccgtgtaactgccaggtcatcttcttgtatattcgatatgattttttcataagcttctatcattttttctttctgacaattgcttaattcaattgccttgttcgtcaaaacaaggtacgttctttcttttttttcatctaatttccagataatatatcctttattttcaagactttttaccatcttagatgtttctggaatcgataatttcatgtattctgccacttctgaaagatatactccttcatgacagtctgatttttcaacacattcctttatactataaaggaacaaataatctgttctttcgacaaattcaaatatgctttcaacattgatgctctttaaaaaaaactcctctgcactggttcctgctcccatattatcgttcctctctttctatatattcttttttgctgactagactcttatatgccgggcgaatgatcttatctgtagttatcaattcttccaggcgatgtgcactccaaccagcaattcttgctatcgcaaataatggcgtgtacaattctcttggaatattcaacatgtcatacacaaaaccactatagaaatctatattaggacttactcctttgaatatctgacgctgctttgcaatcaacttaggtgcaatcttctcaatattgttataaagggtcatatctttctcacgtcctttatcccttgcgagttgttctacaaagcctttgaacaccctttctctcggatcggaaatagaatatacagcatgtcccattccataaataagtcctttctgatcaaacgcctctttcttcaaaatcttactcagatatgatgcaatttcctcttcgtcttcataatctttcacatgacttttaatatcatccatcatattcattaccatcagatttgcaccgccatgtttttttccttttaaggatgacattgctgctgaaataacagaataagtatctgaacctgaagatgttactacccgtgtagtgaatgtagaattgttaccaccaccatgttccatatgtaacaataatgctatatccagtactcttgcttccagttctgtgaattttgtatctggtcttaataggcgcaggaaattttcagcaatagataaatctttttcaggtctatgaatatacatactttcgtttttttcataatgacaataagcatggtatgcatatactgctaacataggaaatactgcgatcaactgcatactctgccttagcacattcggaatttcaagactttctttctccttatcgtaagagcccaatgtaagaatacttcgagtcatagaacccataatatctgatgtaggtgctttcataatgacatctctggtaaagttagtcggtagttccatacaatcagatagtcttccctgaaattccattaactgtgtatcagttggcaattctccgaataaaagaagatatgctccttcttcaaagacaaacctttttcctttacttcctgttactaaatcttttatattataaccacgataagataactcgccatcacatggactctttactccatcacgatattcaaaagcttttatatcagaaatatttgtaagccccgtcaacacaccttggcctttttcatctcgtaagcctctttttacaccatactctgaatacagattcttactaatgctatcattttgttcacaaaaaattgcttgctgtttcatataattttccaaattgctcatttgaatcgctcctttcattctgttacgaacttacatactatactcagatattcttgtttccagagcattcagcattgtctgttctttttcttattcttattcattagcaatacaatacaatggaaaactcaatttaacctcaacaaggtttgttttttcatccatgcaaaatcttctttgtacaacagactgttagatataacaaaaacggcctttcaaaaacagttaacttctaaatcaactgttttttgaaaggtcgtttcatcagattcttatagcaatccagcaaataatctcataaataattgtcccagtcgcaaatatgcacttcgtccggtttgatattggtctgtcacatcacgacattctcccatcgttcttatcagatcattttttatttccacaactgcctgacaatctgccataaaacagccgttttcaaaatggtgatataaacttcgataatccagattaattgttccacaagttgccatacagtcatctgccacactcatttttgcatgacagaaaccaggagtccattcataaacacgaacaccatgtttaactaatccatgataaaaagaacgagttatattataaatgaattttttatcagggataccaggtgtgataattcttacgtctacccctcgcttagctgccagacataacgcatgcgtcatttcatctgttatgattagatatggagtcataaaccaacaatatttttcagctttatttatcatactgatataaacttcttctcctacttgctcattatccatagggctgtctgcataaggttgaacaaacccagtttgctgtgccgcataatcatagtggaaaaggtatttactaaaatcagaatcattagcatccttatcacttactgcattccacatttccaaaaatgtcaccgtaagcgactgaacagcatctccttctaaacgaatacctgtatctttccactgtccatacgggtgtgtgtaattaaaatattcgtttgctagattatatccacctgtaaatccgacttttccatcaataactgttatttttctatgatcacgattgttcaaaaacagatttaaacctggcataaacggattgaatacacggcaatgaattcctattgcctccatctttttcacaaaatctgtgttaataaagcctatagaacccatatcatcgtagaatactctaacttccacacctgcttttactcgctcttccagaacatcttgaatcttatgccatgcttcagcgtcttctatcgcatgatattccataaagataaacttctgtgctttctccaaatccttaagctgtgcctctaatcctttcactgcttcatcaaaatacataatatccgtattctgatagattggatactgcgaatttctttgtatgtaacttgctatatttcctgctttcggaattgtttcttttattctgctcaaacactcctgactgtccggaagcattggtaacaatttgctatcaatttctgcatatcgctcacgcattttatgtgtgccaccattcaaaccaatcaacaaatacaggcctacacccataattgggaaaattagaattaagatgacccaaggcattttcatagaggatgtcttatttgatgcgtacaatcccaaaaccaagatcccactcaaaatccttgtaaataaatttatgatttctgcatattcattcaagcgtgttacgatagtaataataaaaatcacttccagaagaatgcaaattatggaaaaacacagccgttttaccccattttttgtttttgctttgccctctaaagtatcttgtttcatatatcttccaccttcctacttgctcagttttctccctaaatttcgtggaacataccaattttgtcttttattctctgcatttcattatctgcttcaatgatagctcttgcagaatgaagtaattcttcacttatctcatcatagccaggcatttcttcaattccttttttatagcgaagttgatgttccaatgttgcccagaaatccataccattggttcgaatctgtaattctacacgcataggtgttttacccttagcaaaaaatactggtatttcaacaatcatatgatagcttcgataaccattcgattttggattttttatataatcttttatttcaataactttaatatcatcctgttgggtaatcaaatctgatatcatataaatatcgtcaataaacgcacaaactattctaacgcctgctacatcattgagatatgtctgtatattttctgttgtaaattcatatcccatcttctgcagtttatcgtaaatactattgggctgcttaattcttgtttttataaaagaaataggatttcgattgttctcaactgaaaattcatcatccaaaacctcaagtttagtttgtatctcccgaatagcacaacgatacatcatcattaaattataaaattttgtagcattatttaaaaactgtagtgattccggactgtccatcctgagttttttacttcatcttttatcatggaactttcctttctacctcatccctgatttcaaaacattatttattttgatagttgattcgttctccttgaattactggataacaaatcattttatcactatccagattttctatatgcatatctactgcactgatctgatggttttcataagtattgtaataataccatccttatggcagacagtggttacgaaagttttaatacctttgcacccctgatccggaagggaatgtatttcgttatccgcatgaaggatatcaacagtaatggtatcctttccgcttatgatttgcctgacagcgaattcgatactcatataagaacaacacttaccagacgccatacgaaagaaacactggggaatcctaacacctataccatacttcagccttctaccgattttgattttcttgatgaaaactgcatgtattacgatattgaattccgtattgtacgtgttcgccttgataatggaacctatatctgtattgccaccaatctttcagaagaagaatttcctctggaagaaatcaataaactttactggatgcgctggggcgaggaaacaagcttccgtgaactcaaatacaccatcggtctaatcaactggcacagcagcaagtatgatggaatccttcaggaaatcaatgcccgtatgattctgtataatttctgtgaattagtgacttctaacgctgtggtaaaaacatctaaaaataccaaacacgtctataaaattaatttcgccatcgcagtaaacatatgcagggcgtatctcaaacacggtggtaacgaaacagagtccatgcttctcatacaaaagtatctgacacctgtcaggtacaatcaaaaatatcctatccccctccgtccaaagagaaatagggatttcatgtatcgggttgcacaaatctcgttaccattatactgcattatgaggcagatatgcaatctatctttttgtcatacacaaaaaacctaaaatgaaattttaaattccactgccctacagggcggtagaatttagtcctgcacagtagatatttactctttcatacatcagtgttattgtaaaagttccttctgacaacagtagaaggagaattatcatgagtaaatatatccctggaaaccagaaacatctaacacttaatgaccgtatctacatcgaaaacgaattatccaaaggtgcgacttttaaagacattgcggcattcctttgtaaagatcctacaaccatctcaaaagaggttaaatcacgacgcctttctgactggtaccacaaaggaactttctacaatgccaaaaacttttgtgtacaccgctatcactgtaaaaaaacaaatgcctgtggaaaaatcatgctctgcggtattaaatgtacatcctgtccaacctgcaaccaaacctgtaaggatttcgaaaaggaacggtgctgcagacttgataaggcgccttatgtatgtaatggctgtccaatgaaaatcaatcattgtaccattgcccataaataccgctatgatgcccgttttgccgaccgtaagtaccgcgaattattaagtagttcccgtgccgggataaatatgacccggcatcagctgcaccaaaaagaccagattgttactccgttgatcgcacagggacagtcaccctatcagatcctgatcaatcatccggaactggatatgtctgtccgctccatgtacacatacatcgataagggactgttcacagccagaaatgtagatctgaaaaggcaggcaaaattcaaaccaagaaagtgccacaaaacacagatcaaagaccgcgaagtatttaccaacagaacctatgcagacttctgttctttggaattaaattcttatgtacaaatggacacagtaaagtcatcaagggactcccagaaaacgctgttaaccatgatctttacagaggaaaaactgtttcttgcatttcttattaaccggtgcacaaaaggtgccgtccgtgctgtatttgaccgtttggaaaaacgtatgggaacgtatgaatttacatctgtttttgaaaatatcttaaccgaccgtggctctgaatttgggaacccagaagaattagaaactggaattaccggcatacaaagaagcagcatttattactgtgatccaatgcgtagcggacaaaaaggaaccatcgaacaggcgcataccatgctccgcatgatattgcctaaaggaacatcctttgaatttctaacccaatgggatgtcaatcttattgtgaatcacataaactctactccaagagaaagccttgacggcaaaacgccgtatgatgctgccctggaaacacttggagaagatgttcttaaagcctttcagctcaagccggtttcaccagatgaagtcaatttaacgcctaagctgatacgctttaagaagtaactaattaactgatcgaaatctgctgtcagactggaagtaaacatttcacattttttaaatgtggctggtggaatttagtctgacacaccgaattccagtagcctgtttttcatgccataaaaacaacaaaatttcgataagctagcttaattataacagaaagcaagagattttgttaaaaaaactcctgcaaaatcagcaaaatttaaaagccgatggaatttactcttgcactggaatttactttttcaagtcagccatacacaaaaaaatgatttgaactcatcatacatctgctttctacgcattagtgcaccaaaaaaatacagcatttcttaactgaacagtattttcaatgcatgaacgcatatgatatactgttttcatcataaaaaaccttatctaaatgacattgatttttaacacattcatataagtaaaccaattgtcccactatgctttcgcatacatcaatacaatccaagtttattgtagcagctgaaacatattcattaaccggaataatcaaatcatctttattaaacataattccacttcctccaaacaagaaataattaaatgcaactgagtatacaagataacattctttttatcgtccttatcaagttttttaatttccttaacaaatctaacatgaatatcacgaaattctgcttctgaaatcaattcatgattcaatattattaaatttattacacatgaacagatatagttctgcgttttctttatgcaaaaatatcgtttctcttgaaatatcatactctatttcagtagtaccttgattattatatcctacggcaaatacttgccaatatgtccataggttaatttcctgacacaaatcttctccctgacgtaaatcacaccagccaagtgtcaggctcttagcatatataggatttttacgatatttgtttttacaatttctatcagattgcgataatctactgattttttttcattcatttatatattcacctcaaaaatgcactgttttattttaacactttccttatctgcttatccgttgcatccggaaacatctcatgcatatagtctacaagaagtttccatgaatcctgtggattatccttgtagcaggaagtcacataatcgtatccatagatatgctcaatggatgaatatactgcaacatcccatccgtattcaatacctctcttattcactctcttcttaaaatcgcagttgcacaggtaaatctgcatcataagattcgttattgcaccatcaaatcccttttctccatccttaccaaatccagcttgttttttcaattcatttgaataaatctctgaatcagcattatcatccataaaattgaccattatctttttatgcttattaggtgctttctcatcatcatataatgcatcaaaatcatatccatcccggcgataattagcaaatacaggaagccacttttttgatataaatcctgccttcttatcaaagaactttccatagacgatatcatgccgccttgctataatagcccgccacatccatggatcaatctccggattatcactccaccagtactctggaacagttctttcttcaagtgaaaacccatctatgtcattcttaaataatggtaaaaagccaaattcatttatatacttgattgcttcatctacagaatggatgcaatccgggttgtcccaattcatgccatgcataatccattcacctgattcgtttcccataatatgtgtacctcattactcagcgtacttgtcaatccaattttcgccatcatattcatcaatctgttttactaatctcgtaagataatcttgtaacctgctatcttcttcacttgcataccacacatttgcccgtccaaatccataagcccaaccatttgattttcttgggacttcccattgtacctttcttgatctgatccctgcaggaagtaagacacaatcagatgagtttgcaattgcattgtaatattgtatatcttctggagcaaacactgcctcttgataatgtctgaaaactgtagcatgtttataccatcccacgaccgttgtaaacttatgcgccggatgctttgcacagtacacaacaagcacatcatctacagattcttctttttttaatagttcacaacctgcaatattctcaatccgcatttgattgacatctttaccattatgtgattttgtctcgaaaaaccccagacagtataagccctccttgccctccatattcaccggtgtaaaattatatttttcatgtgcatctcctgtctcatcaacatagcttccaccatttaacggagtatcctttccatcttcatttcctcgatactccttcatccacgctatgttacaaaaaagtattctcatcatatcaaccttcttttccctttgaaaatggactcaagtcgataaacaatttcttcaatccacttgtgtccttgaactccttgaataaatatcagaaagtgtctttgaaggataaagcagggcaaacaggctcatgcctcttacttctccatttgaaacattaaacctgagccttgccaccgggtatcgtctcgaaccatccgcaaaataccccgtattcttcttatcctgattctttatctgatgtaccagttttccaactgtaagtctttccgcctcataggaaacaagcgcacctatcattcgtggaaccatctcccatgcagaaaatacaagtatttttgaaaagcctttgctgtttttatatgctccctgcatctcataatatggcaatgatggaggaatccacagatatttttctgcaccgccggtaaatgctttttctttcagtgcctcaatcggtttgttcaaagaagactggagcaatattcaaattgtaaactgctgcatctgcgcaatcatcaaattcttcgcaaacaccagccgcttcaatattaattcttttgatatcatggccgtcaataacaatagaagaagactggtcaagcattttccccgaccagttctttttacttttaataacaatatttacttcagctgtattaatctccaatattttatcagagccagtaggaagtaaagccatcctcttcaaatctcctcatcatataacatattttttctgcagattttttgtatacacattctttatctttgatatacttatccatttgacgccatacagagtcttgactgattccgctatagtctcctgcaaaattcttaaaaagagcaatcaacaattctttaacagatattccgcttccctgaatacgcggaagaatcttttgcataatttcgttatccattgcttcattttctgccaataatccactctttttgttattcaacatataaaatacaatctcatccctgacgcgatatcctacatgcgaattagcctcttgcaatatttcattaatactttgcaactgagaacaaattttgataacaaaattctgatcttctacatccacatccttttttaaaacaatgtactcagatttaagaaaatcatttgttacttcacaagcttcagcatcttgtacttcttcaaaatcagggactaaatcaacatatgaaaactcaattgtgtttgccctgtccagtactttcttactaaatgggaaagtagtttcatccatattgaccgtaccaattagatacaagttttcaggaatgtaaatctctggatacaaatgcatctgttttatagatgcctgtatctactcttttacgtcatcaaatccgaaatcatatgcttaagcgtgcggatttccaacggatgatcttccgtttcaaaagtgaataaaacatctgtccccggcaataaatggttctcataatacaaactgttcttccaaacaaaatcagaaacatactctggtttgctcatcagtcccgcatgctcccaataggtaaactttcctgtctgtgtatttaaaattgtaaaatccggataaactatgattttacgcccttgatatcttaattttagcggccgctcatatttgtataaaagctgatctgctttcatatgtaatagatttgctataatcacctctgacttagaacgcacaaattcacctgcgtttgtctcatacctcaatgtctccgggtatttattgcatggttcatatgtttcctgttcccatgcccgaatccgatgtgtacaattctcttccaatggtataatcaacgactgcctgtcttctgtcattgattcatactacttttttctttttcccatcatgatttgatataaaaagtagtacttaattgcttcattcttgcttatagtactactttgcctttacatcatctaaaattcttgcttaaagtagtactttgcaatctctttatgcgcttttagtaccatttcttccatgccaccctttctgaaagcttttcaaaaagctgttccccacacacaacaattcttttgctccctcttcaaatatttctatttcttgggcaccaaaaactcaccctatcatcctttatctcacacaatcattcaatttttattttacatctgagatttcatccgacacggatatcaataagaacaatatccccaaaagcatttgaaattgcttattcaaaaaagtaacaaccacaaaagtggctccccacacaacataataacactctcaaatgcagtattgctctgtgatttgatatagaaaatatcagccccatcaaatgatggggctgatatgcaacacgagcctagatctggttcatgtaaatctgctttattctgttatgagatgcctcacaacaaaacgactcacaataaattatttagctgccttctcagcaatagctgcctgtgctgctgcaagacgagcgatcggtacacggaatggagaacatgaaacgtaatccagaccaatcttgtggcagaactcaacagatgaaggatctccaccatgctcaccacagataccaacgtgaagcttaggattaaccggcttaccaagtttgatagctgtctccattaacttaccaacacctgtctggtcaagcttagcgaatggatcgctctcgaagatcttcttatcatagtaagcatttaagaacttacctgcatcatcacgagagaatccgaatgtcatctgtgttaaatcgtttgtaccgaagcagaagaagtcagcctctgtagcgatctcatcggctgtaagagcagctcttgggatctcgatcattgtaccaacctcgtactcaagttttacaccggcagcagcgatctcagcatcagcggtctctactacgatattcttaacatacttaagctccttaacttcacatacaagtggaatcatgatctctggcttaactgtccaatctgcatgctccttctgtacttcaattgctgcacggataacagcctttgtctgcatcttggcaatagaaggataagtaacagcaagacggcatcctctgtgtcccatcattgggttgaactcatgaagtgatgcacagatagccttgatctcttctactgatttattcttagccttagcaagcttctcaatgtcagcgtcctctgtaggaacgaactcatgaagaggtggatccaggaaacggatggttaccgggcatccctcaagagcctcatagagagccttgaagtcagactgctgatatggaagaatcttgtcaagagcaacttctctctcttcctctgtatcagaacagatcatctcacggaaagcagcgattctctccggatcaaagaacatatgctctgtacggcagagtccgataccttctgcaccgagctcacgagccttcttagcatcagccggggtatcagcgtttgtacgaaccttaagagttctgaactcatcagcccaggccataacacgtccgaactcaccagcgatagaagcgtctacggttgggatcagtccagcgtaaatgttaccagttgtaccatcgatagagatctcagatccctctgtgaatgtctgtccagcgagtgtgaacttcttgttctcctcgtccatgttgatgtcgccacatccagatacacagcaggtacccataccacgggcaactacggctgcgtggcttgtcataccaccacgtacggtaaggataccctgagcagccttcatacctgtgatatcttccggagatgtctcaagacgtacaagaacgaccttctctcctctttcagcccagctttcagcatcgtcagctgtaaatacaaccttaccacaagcagctcctggagatgctccaagaccctttccaagtggagttgcagccttaagtgcagcagcatcgaactgtggatgtaataatgtatcaaggttacgaggatcgatcatagcaactgcctcttccggagtcttatgtccctcgtctactaaatcgcaagcgatctttaatgcggccggagctgttctcttaccgttacggcactgaagcatgtataacttcttgttctcaacagtaaactccatatcctgcatatcatggtagtgattctcaagagtctcacataccttaaggaattcagcgtatgcttctgggaactcctgctccatctgagcgattggcattggagtacgaacaccggcaactacgtcctcaccctgtgcattgatcaggaactcacccataagcttgttctcgccagttgcaggatcacgagtgaatgcaacacctgtaccagactgatcatttaagttaccgaataccattggcattacgttaacagcggttccccaagaatatgggatatcgttgtctcttctatatacgttagcacgtgggttgtcccatgaacggaatacagcctcgattgcaagctttaactgctctacaggatcggaagggaactctgttcctaactgattcttgtactcagccttgaactgctctgctaattcctttaagtctgctgctgtaaggtcaacgtcaaacttaacacctctgtcagctttcatcttgtcgatgagctgctcgaagtatttcttaccaacttccattacaacgtcagagaacatctgaatgaaacgacgatatgaatcgtatacgaatctctcaaactttggatccgggttaccagcgatcatagctgctactacatcgtcgttaagaccaaggttaaggatcgtatccatcataccaggcatagaagcacgtgctccggaacgtacagatacaagaagaggattcttaagatcaccgaacttcttgccgttctctttttccatccaagctacaccttccatagcctgagccataatttcatcattgattttacgtccatcctcatagtactgagtacatgcctcagttgtgatggtgaatccctgtggtactggaagaccgatttcagtcatctcagcaaggttagcgcccttaccaccgagaaggttacgcatggtcatgttaccttctttgaaggtgtatacccacttgtttgccatttgacaattcctcctaatatttgtttattgtataaattcgaaaaacgaataacatgatccgttttccataaagctgagccgtgaacacagacttcacgactatgctatacttattgtaacacagaattcgcatttcgcaagcattttttaccatagttatgccccatgaatcacagagccggacgcaaaccatccgttttgtaatccacagggcagacttttatttacgcgatattaaaattcaaattttttctcaaaatatgcatccagctcatcgattttaattctttcctgctgcatggtgtcacggtcacgtacggtaacggctccatcctcttcggaatcaaaatcataggtaacacagaatggtgtaccaatctcatcctgacggcggtaacgctttccgatcgttcctctgtcatcaaactcacaattgtatttctttgccagctgggcatatactttttccgcaccctcatttaacttcttggataacggaagcacaccgatcttaaccggagcaagtgccggatggaaatggaaaacggttcttacgtccggcttttcctctgttccgatattttcctcatcgtatgcggcacataaaaatgccagaaccacacgatcagcaccaagtgatggctcaataacataaggaatatacttttctcccttcgtatcatcaaaatacgtcatatcctgaccggacacattctgatgctgtgtcagatcgtaatcggtacggtcagcaatcccccagagttccccccatccaaacgggaataagaattcaatatccgtcgttcccttagaatagaaacacagttcctctgcagaatgatcacgcagacgcatctcgtcttccttaattcccagagataacagccagtcacggcagaacgctctccagtactggaaccactctaaatcggtacccggctcacagaaaaattccagctccatctgctcaaactctctcgtacggaatgtgaagttacccggtgtaatctcattacggaaagacttgccgatctgtccaattccaaacggaatcttcttacgtgaagttctctgcacatttttgaagttgacgaaaatgccctgtgcggtttccggacgaagatatacggtattttttgcatcttctgtaactccctggaatgtcttaaacatcagattaaactgacggatgtctgtaaaattatgcttaccgcaggaaggacatggaatgttatggctttcaataaaatctaccattttctcattggaccatccatctacggatccttccaactcaatgttattctcctgtgcaaaatcttcgatcagcttatctgcacggaaacgctcatgacattctttacaatccatcagtggatcagaaaaacctcccagatgtccggaagcaacccaggtctgtgggttcatcaggatggcgcagtccacaccaacattgtatgggttttcctgtatgaacttcttccaccatgcacgcttcacattgtttttcagttctacaccaagatttccgtaatcccatgtatttgcaagacctccgtagatttcagatcccggatatacaaaacctcttgcttttgctacctgcacaattttgtccatcgtcttttccattatgtaatcctcacattctattatgtattttctgatccgcccaaaggctggatctgagttacttataaattatataggtatatacctgactgaattcgcctgtggcatcatcggtactggtatcttcctcgtcaaactgaaacttcacttcggattcctgctccgtaacatcgatcagatcgtcatcggataccactcctgtcgtttcctcaatctgtgtgcctgctgcctctgtggcactttccgttccctctgttgttttttccgctgcaagaagggacgttccttctttgattgcaatggtctgtgcatccacataactggtatttgtcgtggatacataacaaatggttccttttacttttacatttgtatttccacggattacaaccactttgtagctggagtcatccagaaatgcgctgctctcacacgctttgatctttccgttttttacggatgcaaacgatccgtcaaaagaataccctgcggccagtgcttctgcaacacttcccgtatacagttccatatcattaaatttctgataatcttcggctgtacggtacgcaatggtaagcgttgcctttttttctcctgtgtcgagttttttcagcgaaacgcttccctttccgtttttctcattataggtatctatttcatttttgacatattctttcaatccgtctttatcatatgtcttttcgtcaaaattttccacatcggtagacacgatttttccatctttcagtacaaaaactgtgctttcatccgctttgtaagaagtgccgcaaccggtaaacattcctacgctaagcagtaataccagcacgatctgaccgaatttcttcatgatttcacaaatcctcctctattcacaatccatgatattatacacttttcatattcccatttcaaccgaaaatcgaaagggacttaaagtcatgatgcacataatacgccatatattctttcataatcatcttcagttcccttagtacttcctctgaaacggtaaacgagtataatctggcgacaggtgtggatatgatatactgcatcgtatatcgcgtggaatcggaaatatacatgccctgtacttccttcgcacaggttctgcagaagatgcctccccttttcaccgaaaagaaacacaggtcttctttcgtatgacaatgcatacaggcaaacacctgcggtccttctccattgatggttatggcttttagttcaaacactgcacgcacaagttctttggaatacctgctgttttccagtgcacgaaacgactggtacaaaagcttaagcatttcccgctcatcattattttcctgacaataatattccgcgaattctgcaaagtagaacgcaagcgatgctgcatccagatccaaaaccagttcgcgaaaataattctgaatgtttgccttggtaacattataggaatttcttccctcaaacacttcgaattcgccaaaggcaaagggatttgtcgctgccagcagctggctcgacggtcgtctggcacctctggcaaacgctgtgatttttcccctttcctttgtcagaattgttattcttttgtcataatcattgacaggcatggctgttaaaaccatgcccatcactatcacagactgactcatacttctgctgttccttctgtccgtgacctccgacgctttctgcgacgtccgtcacttcattccgataagtcagataatcggtaacttttcctgttgtccagaatgtttcccaggttttctccattgcaccttacctccattactatcgtctgcaatggcagtaattctattcccgaaaaatattggaaacccatcatctgatctttatcttttattcttcctcccgatacccgaaatttttaatcagaaaatcactgtctctccagtctttcttcaccttcacccaaagttttaaattcactttggcatccagcattttttccatctcgtaacgcgcattggttccgatctttttaagcatcgacccctgctttccgataataattcccttgtgggaatcccgttcacacacaatcgttgcgtcgatatcatacatctttccgcctttgcgcggtttcatctggtcgatggcaacggcaattccatgcggtacttcatcgcttaacgcatgaagtgctttttctcttatgatctccgcacagatcgcacgctccggctgatcggtaatcgtatcctcgtcataaaactgcggaccatacggaagatacttaaaaatagaatcaatcacgtcatccacattctgtccgcgaagggcggaagtcggaataatctccgcgaaatcataaatcttgcggtaggtatcaataaactccagtaccttgtctttttccacggtatcaactttattgatcacaagaatcacaggcgtctgaacttttttcagctgttctacaatgtgctgttcccccgcaccgataaaattactcggctccaccagccacaatacgacatccacctcgttcagtgtcttttctgcaacatttaccatatattcaccaagcttattttttgctttgtgaattcccggcgtgtcaagaaaaacgatctgtccacgctccatatccgtatacacggtctggatccggtttctggttgtctgcggcttattggatgtgattgcaatcttctgtccgatcagacggttcatcaacgttgattttcctacatttggtctgccgataattgtaacaaaccctgacttaaaatttgctgctgtcatttgtatctcctttatcgtgctattcgcacagtccctgaattgaggtaaacataccgctttcttcacggattgcatgctcatttcccactacacacagacactgatcagaaaggatcgaggcgatcagatccgaaagactgcggatatctgccggtgtcgctgtcagtatctcgtcacgctctttttggatttcctcataggtcagatgttccagataagcagccatcgaacggcttccctttgcttccgggtttaacggtgtatctaaagctccaaacgtgccaatgatatattttgtcatatcacgctcatccggatcaaaggatgctacatattccggaattttctcatagacggcattggtctttgccagattcgggtcccggtaagatacaaaataactgtctccggtcctaaggaaagaactcatacatccatatgcaccgccctttacacggatattcatccacagatattcatagcttaaaatcatttttaaaatctttaaggttccgtgatatgcgtatccatggctgataaagttaccagatcttgccacatactggatctgggaggcgtccgtaaatccctcatttttcttagaaagcaccggatggattgcagcctgcgccggtgttccttccggaagtttctttagatacttctgcatgatcggggaagctttttcataagagccttcttctccggtaaagctgacgagcattctctttctgacaaatactttttctatcagctgctgcagtttttcggctaccgcctgcggattctctttcatctgttcatccagtctgcggatcatctgattgtatgcaataccaattgtcgcatcattataaaatgcataaacagattcgtaagaaagtgcacgcattgcagctactgtgtgcccgctgctgcttaagttcacctgcagtctggatttcacctgtgcaatcagttccgccagtcgtttggtatcgtgcagatccgaactgtttaagatttcctctgccagtttcatggcatgctccagattgctctcaagcactttcatgcggatctcaaatttaactgccatcgcatcgtgatttttcagatccggatacatgctgaccccactggtaattccgccggtataaatattgatggcatttgcaagatcggcataactgtaggatctggtattgacatatccgagtaccgcgcgcagaagtccaaggtacggaacctcctcctctgcaatgtcattgcactcaaacatcagagtaatataatcgatgccatttgccggtgcctcatgccggacaaccggaatttctcccatgttctcctccttattggaaaacggcatggcttcttttttcatatcctctctgccaagcatcggaattttcaacagatcttcttcctttgacggttcttcctgatattcccgcagatgtctggtctgggcaatcagcgcctgcacctcttcgtcgcttaatccggccttatatgcggcaagtttttctgccagtgcctgttccctgacacggttaagtcccttctccggcgcaaccacaaccacagcaccgtgcgcgttgtccagcagatacttctgaatcagatcttcaaaatatccggttttgatctgctcccgcaaaaactgtaatgtatccagacattccagatgaataaacggcttggtatcatcaaacagccagctttccatacactgcagtccatacaaaagtcccttcggaaactgtccgtaatctgcttcccggaaccggaattccgcactgttaattcccgcaagaagggaatcctgattcagaccttcctttaccagcttctgtaaggtttcctcgataatctgcacaaaacgggtctgatcagactcatcggcattcttagcgacaatggagaacatcggctgaagcatgccatcctcaaaagatccgtagacatcttccccgattcccgcatcaatcagtgcctggcgtaccggtgctcccggcgcactgaccaggacataatccagtatagaaaatgcctgatacaattcacggtcaagaacggttcccaccactttattgtaagaaagatacgtgtgcttctcctccggttcatcctctgtgatcggatacgttctgcgctcggatactaccgcgtcaaatggcttttgcaactggatttgtgaatgtacttccacttcatttgcatcataatggcttaaatattcctcatccagccaggtgagcctctcttctatatccatatctccgtacaaataaatataggagttgcatgggtgataatatttgtgataaaacgcaagatagttttcatacgtcagttccggtattttttccgggtttcctccggaatttttgctgtaggtgttgtctggaaacagtgcttccataattgccgtctcaagcacttcatccggggaggaatatgcccccttcatttcattgtatacaacgccgttgatggtcagcggtgcatcttctgactccagctcatagtgccagccttcctgcataaaaatctctttatactttgtaatatttggatggaataccgcatccagatatacctccatcagatttttaaaatcccgctcattgtaacttgctaccggatacagtgttttttccggatatgtcattgcattcaaaaacgtattgagtgaccctttcgcaagctcaataaaagggtctttgaccggaaatttatccgagccgcaaagcgtagtatgctcaataatatgcggaactcctgtctcatcttccgggggtgtccgaaatccgatcgaaaacaccttattgtcatcttcattggaaatgacacacacgcgtgctccgctttttttgtgtcgcagaatatatcccatggattcaatatctgcaatctttcttacttctattatttcatatgctgacaatttcaatttatccatatttctcatccttccatttttatttcaacggaatagttttattctttccgaatcgatacatccatctgtgggaatggaatcgaaattccattttcatccagtgcatttttcatctgctccagcaaacgccaccgcaccggccagtaatcttctgtttttacccatacgcgaatgcccatatctacggcactatcccccagatccgatacaaaaatatcgaccggttcatcctttatcactgcggtttctgtctttaccacaccctcaagcactgctttaacctttgacaaatccgatgcatagccaaccccgacggtcagatcaatccgtcgcatatccatatggctgtaattggtaatactgctgttggacagacttccattcggaatcaggatcagtttgttatcaatggtaagcagcttggtgtaaaaaatggtaatctcctttacagttccttcttctgatgaagcattatccaatatataatcgcctaccacaaatggtttcagcaacaaaatcagaacaccaccggcaaaattagaaaggcttccctgcagtgccagtcccatggtaagtcctgcggaccccagcacggcaatcacagagcttgtcgtcacgccaaactgccccagaataatcattgccagcacaaaatagagcgcatatttcacaaaagaactcagaaaggaaaccacaccggcttctacttttccgcgctctaagaaacggcgcaccattttcaccagcattttgatcatccggctgcctaccagaagaataatcactgcaatcatcagctgaatgagaaaccccagcagagatggtgtcagatcctgtaaatatttccggataattcccggatttttcgccacttcatttaacacttcactctcggtgctaagctgtgtcagttggtctgttattaaaattcccaatgtatttctccatttatgtcctataatgccattctttaaatctcatggatgaataatccactgcggagtttcggctcaaaccaggtagatttcggcggcatgagacgtcccgcatccgccacagcaaacaactcctgaatggatgtcggatacatggcaaatgcaaccttacagtcctcatggcatcttctttctaactctttcatgccgcgtattccgccgacaaaatcaattcttttatctgtctttggatcaccgattccaagtaccggtgccaaaagtacattctgcaataccgatacgtccagtccttctaccggatcctccggaaccgactctggacgcatagtacaacgataccatttatcagaaagaaacatggaaaactgtccctttttcaccggtcgtacatcgtctttgtttccgatttcctgcacatcaaaaagttcctgcatttttgataaaaatgcctcttcggtcatatctcctaaatcccgtaccacacggttgtaatccatgatcatcagttcctcatccgggaataaaacggaaaggaaataattaaattcttcttttccggtatatcccggatgttcttctctccgcttaaatccgacttttaccgcagaagcagctctgtgatgtccgtctgcaatatagatttccccaatctgtgcaaatgcattccggatcgttttgatatcttccggatcggatattacaaaaacacggtggcgaataccatcttccgcaacaaaatcatataaggcatcctgtttctttgtctttgccacaacctcattgatcacggcattggcacggtatgccagaaagatcggtccggtctgtgcactgcacgtatctacgtgacggatacgatcctgttccttatccgcacgggtattctcatgttttttgatgacctgatccgcataatcatcaatggatgcacatgccgcaatgccggtctgtgttcttccatccatcgtcagttcatatatgtaataacattctctgttatcccggataaatgtgccgtctgcgatccagtcttttaacatctgtgccgctttggcatatactctgtcatcataggtatcgacatcatccggaaactgtgtctccgcacggtcaattgccagaaatgactttggattttttgccacaacttcttttgcttcttctctgttatatacatcatatggtaatgcagccactgcagatactacatcttctgccggtctgacacatacaaatggttttatgtctgccatattatcctccataaattgtgctcgtttctatacctttctagtataatggaaaaaatacgtttatacaagaaaaaatatggcggttctttcgaaccgccatacagcaaaatgcttatcttttctgttattttacaacgcgtacacgcaatacatcgtcaattgcctgcagttttttcagcacatcatcggtaatctgggaatccacatcgatcagtgcatatgcatagtcaccctttgccttatttgtcatatctgacacattgatatctgcctctccaagaacggtcgtatactggccgatcatacccttgacattcttgtgcagaattgcaacacgtccggctgtggtacatgctcccatgttgcagtccggataattgacagaatgggtaatattaccattctccatgtagtcacgaatctcacggacagccataattgcgcagttgtcttcagactctgctgtagatgctccaagatgtggagtgacaatacatccctttgctccaacagttgtagtattcgggaaatcagaaacatatttcttaatctttcctgcagccagcgcatcaaccattgcctcttcgtctaccagcagatctcttgcaaagtttaatacaattgcggtaggcttcatcattgcgatcgcattggcatcaatcatctttctggtagaatccaaaagaggtacatggatcgtaatgtaatcgcactctttgtaaatatcttctacattgctgatatgctttacgcttctggataagttccatgcagcattgacagaaatatatggatcatatccatatacttccatacccatatgggttgcggcatttgctacgagcacaccgatggctccaagtccgatgacacctaatttctttccggaaatctctgttcctgcaaagttcttcttctgtttctctgcagtttttgcaatgttatcatcgttctggtttgccagacaccagtcaataccaccgacaatatcgcgggatgcatataacattcctgcaaaaacaagttcttttacaccattggcatttgcacccggtgtattaaatacaacgatacctttgtcagcacatttgtcaagcggaatattgttgacacctgcaccggcacgggcaactgcaagcagtgaatccggaagatccagatcgtgcattgccgcactgcggacaagtgctgcatcagcgcccgccagatcgtctacttttttgtaatcatcagaaaataaatccagacctaccccagcgataggatttaagcatgtataattaaacattttatgcattctccttctcaaatttcttcatgaactcaacaagcttttctacgccctcttttggcattgcgttgtaaatggatgcacgcataccgccaacggtacgatgtcctttcaggtttacgaagccagcctcggttgcctcttttacgaatttcgcatccatatccttgtctccggttacgaacggtacattcatcagtgaacggtcttcttttctgacagttcccttgaacagtttgctctcatccaggaaatcataaaggatctttgctttttcaatgttgcgtctctgcatttcctctaagccgcccatctttttcagccacttaaagactttaccgcagatataaatgccgtagcatggcggtgtgttgtacaggctgtctttgtctgcctgtgtcttccacttgagcatggttggtgtgccaggaagtacatcatctgtaatcaggtcttcccgtgcaattacgattacaacacctgccggtccgatattcttctgtacgccaccatagattacgccatactttgtcacatctacaggctcagataagaagcaggaagatacatctgctaccagtgtctttccctttgtgtttggaagcttcttgtatttggttccgtaaatggtgttgttctcacagatataaacgtaatccagatcatccggaatatccagatcggaacaatccggaatataagagaatgtctgatctgcagaggatgcaagctcaatggcctctccgtacatctgtgcttcctgatacgccttctttgcccactgtcctgtgacaatgtatccggctttcttattcttcatcaggttcataggaactgctgcaaactgctgagatgctccaccctgtaagaacaataccttataattatccggaatgttcatcagctctcttaaatctttttctgcatccttgatgatgtcatcgaacactttggatctgtggctcatttccataacggacatgccgcatcctctgtaatccaacatttcatctgctgcttcctgcagtacctcctccggcaatactgccggtcctgctgagaaattgtatactctgctcatttcaaacttcctcctatattttactatgctgttgcttacttattcttgctctcgaaatcttttccatcgaaacattcattgatcggagcccccggtgcaaccatcggccataccttgtcatccgaatccacaattgcgtcaattacaaacggcgtcttactttccaatgcttcctgaaaagctgcgttaaactcttcctgtgttgtcacacgccgggcggttgcgcccatcgcctctgcaatctttacgtagtccacaccgtcatctaaaaccgttgcggaataatgctgtttatagaaaagtgtctgccactggcggaccattccgagtacatggttattgacaatcacttcaatcaacggaagcttttgtttggatgctgttgcaagttcattcatattcatgcggaaacatccgtctcccgcaatattgatcacctgcttatccggatttgcagtctgtgcaccaattgcagcgccaagaccataccccatcgtaccaagacctccggatgtcagcagggttcttggtttactgtatttaaaatactgtgcagcccacatctgatgctgaccgacttccgtgaccataatggcatcttttgccatctcatagatctttgcgatcataaacggaccacttaacccttcctttggaatggtcataggatacatcttctgataatccgcaatatgggaaagccactcggtatgtttctgctgctcaagtttttcattcagctttccgaggacgattgccacatccccgataatgctgtgatttacgataatatttttattgatttctaccggatcaatatcaatctgcagaatctttgcctgttttgcaaatttctttggatttccaagtacacggtcagaaaaacgaacaccaattgcgatcagaagatcacattcactgacaccgagattggacgtctttgttccgtgcattccaagcattccggtatagttttctgatgttccatcatatgcaccttttcccatcagtgtgtcgcagaccggtgcatctgttttttctacaaatgtctttaatacttcactggctccggaaaggattgctcctcctccgacaaatatgtacggcttctttgccttttcaatcatctggatggctttctttaaatcatcctcattgaatgccgaacaatccggctgcggcatttttggctctttctttatatactctgttttgttggcagtcacatccttggtgatatctaccagaaccgggcccggacgtcctttccgcgcaatggaaaacgctctgcgaatcgtatcggcaagttttgttacatcttttacaataaaactgtattttgtaatcggtgttgtgatgccagcaatatcaatttcctgaaaactgtcttttccgaggagtgataccccaacattgcaggtgattgccacgatcggaatggaatccatatacgcagttgcgataccggtcaccagattggtggctcccggtccgcttgttgccatacagactccgacttttcctgtacttctggcatatccgtctgctgcatgggaagccccctgctcatgcgaggtaagtacatgccggatttccggatgtttgtataattcatcataaacgttcaggattgcaccgcccggatatccgaaaacggtatctacaccctgttctttcaggcattctataatcacctgtgatcctgtcaactgcattttctaaccctctatcctttatttctcttctggcacttccaagacagctccacggtttccggaagtaaccagtgcagaatatctcttaagatatccggtggtaaccttcggctctctcggctgccattttgcacgtcgtgcggccatctcttcatccgaaacatctacgttcaatgtcatctccgggatattgatctttatgatatcgccctcttctaccagagcaatcggtcccccaactgctgcttccggagaaacatgtccgatggatgcgcctctggatgcaccggaaaaacgtccgtcggtaatcagggcaacggaactgccaagccccataccggcaatcgcagaagtcggatttaacatttctctcataccaggtccgcccttcggtccctcatagcggatgacaacgacttccccctctacaatcttgccgcccttgatcgctgcgatagcatcttcctcacactcaaagactcttgccggtccttcatgaaccatcatctcatcgacaacagcagaacgcttaaccaccgaaccatccggtgccagatttcctttcagaacagccagaccaccggtcttggaatatggatgatcaaccggacggatgacttccggattgcggttcactgcgtttgcaatgttctctccgatcgtctttccggttacggtcatacaatcggtatgtaacagaccgatatctgccagttctttcatcactgcatatacaccgccggcttcattgagatcctccatataagtaggaccagccggtgccagatggcagaggtttggtgtcttttcgctgatcgggtttgcaaagctgatatcaaaatcaaaaccgatctcatgcgcgatcgccggcagatgcagcatggagtttgtggaacatcccagtgccatatctactgtcagtgcatttaagatggactcttttgtaataatatcacgcgcgcagatattcttgcggaacatatccataactgccatacctgcatgttttgcaagtttgatacgttccgagtaaacagccggaatcgttccgtttccgcgaagtcccataccaagagcttcggtcagacagttcatagagtttgctgtatacatgccggagcaggacccacaggtcgggcagactttattctcatattcaagcacatcatcctctgtcatggttcctgctgcgtaagatccgactgcctcaaacatggaagaaagacttctcttctttccctgcacatgtccggcaagcatcggtccgccggatacaaatacggtcggaagattcagacgggcagctgccatcagaagccccggtacattcttatcacagtttggcaccataaccagtgcatcaaactgatgggcgatagccatacactccgtggaatctgcaatcaggtctctggtaaccagagaatatttcatgccgacatgtcccatggcaataccatcacataccgcgattgccggaaatacaaccggtacgccacctgcttccgcaacgccgagttttacggcgtttacaattttatcaatattcatatggcccggaacaatttcattgtaggaacttacaattccgaccattggtttttttaattcttctgcggtaaatccgagcgcattgaaaagactgcgcgccggagcctgctgcataccgctccttgcgttatcacttatcatattatgttctccttaaactctctctgcgatcaggtcgcccatctttgctgtgccaacctgttcgatcccttctgtgctctctcctgcctgcggcatgatatcaatggtacgatatccttcttttaatacctgtttcacggcattctcaatcgcatcagcctctttatccagatcaaacgtatagcgaagcatcatggctgcacttaaaatggttgcaatcgggttggcaatgccttttccggcaatatccggtgcagacccgccactcggctcatataaaccgaatttggtatcattcaaacttgcggatgataacataccgatggaaccggtcaccatggaagcctcatcggataaaatatctccaaacatattctccgtcagaatcacgtcaaactgttttggatctttcacaagctgcattgcacagttatcgacaagcatatgctcatacgttacttccggataatcttttgcaacttcttctacgatttttctccagagccgggaagaatccagaacatttgccttatccacggaagttacctttttacggcgcttcattgcaatgtcaaaacctcgctttgcaattctgcggatctcattttcattgtaggtaagtgtatcggttgctgtcgtcacgccatctacttcctctgtctttcgcgctccgaaatacaaaccgcctgtcagctcacgcataatcatcatatcaaatcctgttccgatgatatcatcacgcagtggacatgcagcctttaattcttcatataaatatgccgggcgaaggtttgcaaacagattgagcgatttacgcagctttaaaagtcctgcctccggacgaagctccggtgctaacttgtaccacggggatgtggaagtatttcctccgatagatcccatcagtaccgcatcacttgcttttgctgccgcaatcgcatcatcggtcaaaggaactccggttgcatcaatcgagcatccacccatcaggatatccgtatagtgaaatgaatgaccatattttttcccaatctggtctaatactttttttgcctctgtaacgatctctggtccaataccgtctcccgagatcacaccaatttgacattccattgcttttcctcttttctactctgctgtttcaaagtctattacctattaatatatagcaacagggccttcttttcaactaaaaatccattttactttttcataaataatataatctgagattataatagatcttttttattattctgaattgaaaaaggaatgcaaaaaggtgccgcaaatgcgacaccctctctcatgttctttatgatgcagattctgctttttctacgtctgcaattgcagctttctgcattggaatacgacagtttttgttgtttccgaactctacgataacggtatcatctacaatatcaataattgttccatagaaaccggatgtagtaagaacggtgtctcccacagctacttcggaaagcatcagatcttttttcttctgctccttcttctgtggacgaatcatcagaaaatacataaatccgaagattactaccagccagataatcataccaaacatgcccattccgccggaagcggaagcgctgctatttgctaaaattgcgctcatcaatgtttcctcctatattcaaatactaaaacccattctacacaacttccgttctttgggcaagcctttttggcttttttagacattttttatacttgactgtcccatccggtacagtttttcttctttgtaggaagcaaaatttccggcatcgagagcatcccggatctcttccatcatggtattgtaaaaatacaggttatgaagaacacacaggcgcatgccaagcatttcctttgcttttaacagatgccggatataggctctgctgtagtgccggcatgccggacactggcagccctcctcaatcggacgcatgtctttttcgtatttctggttaaacagattcaactttccttcgttggtatatacatgtccgtggcgtccgtttctgctcggatatacacagtcaaagaaatcgattccgcgcgctaccccctcgagaatatttgcaggtgttcccacgcccatcagatacgtcggcttgtttttcggaagatacggaacggtctcctctatgatctgatacatctgttcatgggtttctcccactgcaagtccgccaattgcatacccatccagatccagttccgaaattctctttgcatggtccgtccggatatccgaaaaaattgctccctggttaattccaaacaacagctgctctttattaatcgtatcttccagactgttcagacgctgcatttcttttttgcaccgctccagccagcgggccgtacgcgcaacagaatcttcgacatatctgcgctctgccacactcgatggacactcgtcaaatgccatggcaatcgtcgatccgaggtttgactggatctgcatgctctcttccggtcccataaagatctttgcgccatctacatgggaatggaaatatacgccctcctccttaattttccggagtcctgccagggaaaacacctgaaatccgccggaatctgtcagaatcggacgatcccagaccataaacttatgcagtccgcccatttctttgatcagcttgtctcctggacgcacatgcagatgataggtattggacagttccacctgacatttgatctctttgagatccattgttgaaacagcacccttgattgcggccaccgttcccacattcataaataccggcgtctggatatctccgtgcaccgtatgaaacaccgcacgtttcgcactgccttcctgttttaacaactcatatgtagccattttctgttattcctctttctttttatttactttcgaattctgcggatcaaaataccgttggacaaaagtgtggaatctatgtaatgtcgttcaagcagaatttctccctgcggcactacctcgacatcttcctcacaacagttaatcagcacttccacataacaatccggaaaatccactttctgaaactggatcacacgcctgtacgctgcataatcattcggaaaatgaaaattacggctttttaagagcggttcctgccggcgcagatgaatcagtgtagatatgatcctgctgcgctctgcatactttccggcctcaatatccgaccacggcatacatctgcggcagtccggatcatagcttccttccatggcaatttctgttccgtagtaaatgcacggacttcccggcattgcaaaaagcacagcaatctgtgcaaaatattcatccagattcttcacatccgagcgaagccgcttggtatcatgcgaatcgagcagattaaacagcacatcattggtctgctgcatatagcttgtatagcagcggttgattgtatactcaaagtcttcattcgtcaggctcttatcaatccagaaatccttgatactttgtccaagcggataattcattaccgcatcaaactcatctccgcgcagccacggaagcgcgttgtgccagatttctccgagaatatagatatccgggttgatctccttgacccgcgcatgcagttctttgcagaacctgtgggaaacttcatttgccacatccagacggattccatcgattccgtaattttccacccagttggcacaaatatctacaaaatatttgcgtactttcggattgtttgtattgatctttggcatggaatcaaaaaaggcaaatgtataatactgtttcttctttgccgcctgcccgtttttatcaaacggccattcattgatcataaaccagtcataatattccgactctggtccctttgcaagcacatcctgccacggtgcgaaataatatccggaatgattgaacacaccgtcaagcattacgcggatgccccgcttatgtgcttccttcacaaggtgtttaaaggtttcctcatcgccaaaacgcggatcaatcttcgtataatccgtggtatcgtatttgtgatttgacggagcttcgttgatcggtgtcagatacagaccgttgattcccagattctgcagataatccagcttgtctgtaatccccgccagatctcctccgaaacattcctcattggtcacgcttccatgctctctccacaaaaccacattctcaggatcattggaaggatctccgttgcagaaacgatccgggaaaatctgataccatacggtatcattgacccatgccggggtacgcggtacatcacagggattcatccacgggaaaacaaagcactgacggcttctgccctccagatgcatctgttcgctgctgacaaacccgtcttcaaaataaaaccagctttcctcccctgtctgaagttcaaaataatacttcagacgcttgtactccggacgcacggttgtggtccaccagatctgattttttaaccgctttttatatatgatcggctcctttttcccatcccagtgctccccgccgcctaatattcccgcggcaaacggatctccgagtataatggataccgattttacatcgtagcccgtttttatattgataatcagctcatcctcattcagcggataacagtaattgtcactcgcctgatgatatactgcgttaaattccatatgttccctctctcttttttatgtttatttcctttaaatattaccatatctctcttgactattcaatgcgatgttttttataatatcccttagaatattaacgtttttaaggaggcatttatggcaggctcatcatttggcaatttatttcgtatcaccacatggggggaatcccacggtaaaggcatcggtgttgttgtggatggctgtcctgccggactcagcctctgtgaagaagatatccagaaatttttagaccggcgtaaacccggccagtccaaatttaccacacagcgcagggaaagtgacacggtagaaatcttatccggtatctttgagggaaaaacaaccggtaccccgatttccatgatggtctggaacaaggaccagcactctgccgattacagtgaaattgcctcctactaccggccgggacatgctgatttctgttttgacgaaaaatacggatttcgtgattaccgcggcggcggacgctcctcggggcgcgaaacgatcggacgcgttgccggcggtgcaattgcgatcaaaattttagagcagatggacatctccatacttgcctacagtcaggcaatcggtccggtgtccattgatcctgcccggtttgatcccgcagaaatttcaaaaaacaagctgtatatgccggatgcaacagccgcagcaaaagccagcgcatatctcgaaaaatgtttacaggaacaaaactccagcggtggcatcatcgaatgtcagatttttgggcttcccgtcggactcggtgatcccgtttttgaaaaacttgatgcgaatctggcaaaagcaatcctctcgatcggtgccgtaaaaggctttgaaatcggagccggatttggtgcagctaccgctaccggactaaccaacaacgatgcattttgcatggagaatggacatatctccaagagaaccaattattccggtggcacgctcggtggcatgagcgatggctcgctgttatttttccgtgcagccgtcaaaccgacaccgtccattgcagcaacacagcagaccgtcaacaaagacggaaaagaaattgagatcagcatcaaaggacgacacgatccgattatcgttccgcgtgcagtggtcgttgttgaggcaatgacagctatcacgattttagatgcgctcctttccaacatgaccgcaagacttgaccggattattgatttttacagacaataacgtttaatcacaataaaaattggcagtgaggctacgatgcaacagcttcactgccaattttttcttgtttatttttcgtaaagaaattcttccggcaatgtaacgttaaaatcttttgccagatcccggaaattgtccggagtgatcgtctgaagcttatccggtctcatggataacatcttcacaagaatttctgccgatttctcagcggtgtgcatcagaccgaatgtcagatcaaaatcttcgcctgctgcgaacattccgtgatgtgcccaaatggccagatcatactttttcatcagttcacttgttgcaaccgcgatctctcttcctcccggaaccatccacggaacaacaccgacaccgtccggaaaaacaaccggacactccgttgccatctcccacagttctctcgtaaacactttatcttcgagtggaagtacaaatgtgagtgcaataatattggtggtatgtgcatgatagaccacacggtaatttggattttgaagtttttttacttcgagattcatcaaatgactcggaagctcggaagtcggtctgcctccattgaccagcccccagacaatacggtaattttcacctttttcgtccagttcaatcatgcagatggaatcttccggcttaatgatcacattgcggaaatacttaccgcttcccgtaaccagaaaaaactcgccggcaagattcggtacacttgtgccaattggctgccattccttcgccttaaaattctcttttatcaattctacttcttccggttttacacgataagaaaggtttccaccatttctctcatgccatccctgctcccatccgtcattcgccatgcggataaattcctgtacaaattctgcatctaaaaaattcataattataattcctcttttctattcttttttaatttctcttttccaatacttcgttctcatacttttcgatttcatcatagaaatgaagatcatcaacgacgccctcacgtcttaagtactcatcccatatctcaccgatcggcaacatcttcaccgcctcattcataaccataagtttgctcatctgattcgtatcctgaagcgctttgagcattgcattcggtgtacataaagctataagaagggctttctgccagcttcgaaatcctgttgcaagtgccgaaacacggttgatacttgcatcaaaatagtccaaagccatatagacacggtcaagcgcattatctcttacaatttcttttgccatctccttcgtctcatcatcaagaatcagcacatgatcggaatcccagcgcacacctcttgtgatatgcaatgcaaattccggataaaagcagagcattgccggaatcttgtcagatacatactccagtggatgataatgtccgttgtccataagtggcatacagccgtcatgtaaagcagcaaaactaagtgtaaactcagccgatccgactgtgtaagactccacacctataccgaaaacttttgactccacacaaggctttacgaggttatgatcgtatggctccgataagatctgctcgatggaatccttgtatcgcatacgaggtcccatacggtctgccggaacatctttaaatccatcaccggtccagatgttcataacgcaaggcattccggtctcttttgcaaaatattccgagatgcggatgcatgcctttccgtgattgatccagaaacgtcttgtctcctcgtccggactcgaaagtgtctgaccgtcctttactttctcgtgtgagaaaaaggtcggattaaaatcgatacccatatgatgcttcttggcaaattctacccatttagcaaaatgctttggttcaagcgcatctctgtctgcaaattcccccggtgcaaagattgcataagatgcatgtatgtttaattttgcggttcccggcatcagtctcatcgcttcttccatatctgccatcaactgttccggcgttctagcacggcccatataattaccggtcgtttgaatgcctccagtaagtcctccgtcattgtcaaaaccgatcacatcatccagctgccagcagtgaagcgataccggaactttctttaatgtctcgatcgccttgtcggtatccacaccgagtgctgcatatttttctcttgctgcttcgtaatttgtcatgtctcttctcctttacttttcgtatttatgaattgggaaggaagcataaacacattgtcttgcctcctttaagttttctaattctcccgctgcgatcatctgcgcacagagattaccgatcgcagtcgcttccgtcggtcctgcatagattgtcttcttcgtgaaaaatgcggtcagtttgttcagataatccgcattggcaccgccaccaacgatctgaatacagtcgtatgtttttccggtcagtttctcaatctcctttgctgtatcggcatagcattttgcgagactgttgtagatcacacaggcaacttccgcaatgccctgtggcacctgctgtccactctctttacaggctttctgcacctcgctcgtcatatgctccggcgcaagaaatctcggatcgttggcatcaacaaaagaaggaatcgtctgctttgacgcaagttcgctgatctctccaaaaccaagttccggggctatctcctttcgcaccgactggatcatccagagtcccataatattcttaagatagcggaagcgataatcgtatccgccctcattcgtcatgttatgctttctgctttgctcatcacaggcagcttctttcaattcggttcccatcaatgaccatgttccggaactgatataaagtggctgttcctctttggatggaactgccatcactgcagaagctgtatcatgcgttgccggcaagactactttgcattcaaaacctacctgtttctgaatagaatccgccaagtttccgacaatgcttcccgccatcataattgtctgaaagagggttctcggatatcccagccgatcaatcaatgcccagttccagtcattggctttcggatcaaccagctgtgttgttgtcgcgttcgtatattcctgtaacttatttcccgtcaaaagaaagttaaaataatccggaatcataagcatactttgtgccctatccaggctttccggattctgctgcttaagcgccattagctgatagatcgtattaaacttctgcttttgaatacccgtaatttcatacaaatcattttccgaaataatctcatatacctgcttgtccatcccatccgttctcgcatcacgatatgccacggcatcaccaattctttgtccctgatcatccaacaatacaaaatctacagcccaggtatcgattcccatactatacggaatctttcctatatccgcacatttcttcattccggtttgaatttcccaaaaaagctgatccacattccacactttatgtccgttatgttcctgcattccgtttggaaatcgatagatctcctctaagacaattcgcccgtctttcttatgcgcaagaatatggcgtccactcgacgctccgatatcaatcgccagataatatctgttttccattgtctgccccctttttctcttatctgatacaccaaaaagataacaaaaataaggacagctttttagcctctgattagactaaaaaactgtccttattttctgaatagcctttattatcttctcatatgtttttctttcttttcttcatacatgcgcttgtccgccgattcgatcaactgatttaaatcatcaatctcgtcagatgcatgtacggaacatccgatactggcagacaattggtagattctcttctcgttttgattttctttttccattgtattttttatcttacttacgatcatctgcatccgcttggcattcgtacaactcccaaacaccacaaattcatcacctccataacgcattaccagacaatccttcggaactgatgcctttatcacatctgccatctcgcgtatgaaagcatcgccgaccttatgccctaacccatcattgacatggtcctatgtcaagatttagtacaagttaaaatgagaaacttttcccattttaacccgccagaagctcagcctcagtgtgtgttctttcatacaatcgttcgaattcatttggtgacatatagttacaatggctatgaattcgtttcgtattgtagaaagcttccagatattcaaaaatcaactggtatgcctgcttatagtcgcgaattttaaagcgattgagccattcacgtttgataatagaatgaaaggattcaatgcatgcattatcccacggaaaagctttcttcgaataactgcgctgcatattttcggttgcttttttatattcctttgcaacatattggctgccacgatccgaatggataattaatggttgatcaatatttcggcgagctttggctttgtttatagtatcaatcacgcaggatacttccagtgtttctgaaagtgtccaggctatgatttttctggaaaataaatccataatactggtcagatagacaaatccgtctattgtccagatgtaggtgatatccgaacaccagacagcattcgggcggtcaggattaaactgttcatcaaggatattttgtaattctgtgctgaaatcagaatcttttgtggtgatggtccatggtttgctccactgagcacggattcccatttggcgcatatatgtaccaacggttctttccgaaatgacttcaccggtttttcgcagttctacagtgattttcggagcaccgtagttctgcttggaatcatcataaatatcctgtatttttgcttttacagctttacgacgtttttctgtatcagaaggtacgtggtggagccatgcaagatatcctgagcgagagacacctaaaaatttcaacattccggagacggaaacccggcgtccagcctttttggcagcttccgtcttctcagacacttcaagataaatggcttccgtcattttcccagaatgttgattgctttttttaacacatcaagtgcatcttttgcatcacgtaattcacgtctgagacgggcaatttccttctgctcatcagatgcataattaccagaaccacgaacaggaatatcacctgattcccggaagtctttcagccattttgttaatgtgctgtatccgatgccaagattttctgcacatccacgtactccgagatctttgtgatcctgatagtactggactgcatcaagtttaaattgtttgtcatgttgctttgccatatgagatcctccttcagcatgcctctattgtatcatgcttatgtgtatttggaatttctcattttggcttgtactatttatattctagcaccaacactctttagaccgtcaatatctaaaaaaatcataaatgcccgccgatgttgtcctttaatccgttcaacaaccgcatttgcggaataaaaaaagccactccgattgaacacctgtgtcagcatgtcatacttccacatacggttgatcttctcattcatctgattgatccatttccatttgcgaatattttcgagtgccataccgatattaaccgtccataaatatgcaagctcactttttaacgcaaagacacttccatccgagacacaatatccataacatattttttgataataaattggtgtcactatgtagaatgttttctgtaatttatttctcatttcataaggcaaaatttcctttgacggaaattttccataggagtcaaactttctatcatgataggcaagcggtatatgaaccttttgggtatagtgctcacaaatcgcttgttctctgatattagtttttatgtcatcatacgcaaacaactttttttcatcacacaggcaaagataaaactctttcatatctgatcggataacatatttttttaaccgcgaacacaattcttccacactctcaagcccggtcagatcgagttccatactttttaacgcatctagtgcctcctcatagcttaagcattggttctgatattccactcgaagatcccggatcgactttggtgtctggcagttacatccgcagctttcccgatacagaatctgggtttccaatttcacagatgtatgactttgtgcatcaaaaagcagatcgaccgccttttccccgagcatttcctgtctgcgatcaacggtcgtcaaagacggaatataaaatgcggacagctcatcattgtcaaaaccggttactacgatatcttttgggatttcataaccatactgctgcaagcgctccattccgccgatcgccatcgcatcatttgcaaatacaattgcctgcggcgtctggtttttcataaaatattcgatggcttttcttccgctttcacgattataatttccgcagtaaacctgacaatcacaaacaggaatgccatgctcttccatagcatccctatatgcccgataacgttccattccttctttgccctgtagaataccgcacacataattgatttttgtcagatgatgtttctttatcagatgttctacaatacgtttctggctattgtaatccgatattccgacattatgcattccatcaatatattcatcaacacttaccgctggaatcctgctctcttttatccggttcatcaacgagttggaagccggttcatattgtattgaatttttcataacgatcacaccatcgtaggtagtaagatccggaagttccataatttgaaatgctccgactttgttttcttccgactcatcatagttcacaaagcatgtaaaaataaatacatccgtatcgaattccgcagcacgtcttaatacaccgtcgatcacacgattctgattatcaaaactgattgcacctgcaagaaacgcaattttttttctcatgtttcccatctttccctgaatctgatcctaaattttctgaaaacgattcatttcttccataagatgttttgaagagtcaacgttttccgttgcttgttgtcgaatgttcgtgatagaatttgcaagatcagacacattttctgttgcactgctaattccctgtgcattttcttccacaaccgttgatatgttggtgattccattattcatctcagccataaccttatgtaatgccgaaatattatcgttaaaaacagccataacagaatccatatgctctgccttctcataatacgtatccgtagcaccttcaaatccaacgtaatcactcataatccgattttgtacaaagtacataagattttgtgcattctccataagttgatttactgccgatatcacttctacactaatactctgaatatcatttgcagtatttttactgttttcagccaattgtcgaatttcttcagccacaacagcaaaacctttccctacttctccggcacgcgcagcttcaatagatgcatttaaagccagaagatttgtctgacttgcaatatcaagaatatcattggttaaattatttatatttgtaatctgcctgctcgcctctatcgaagaaaataaagcattctgtttttcattaataagatttgaaatttcatttttcttcttttcagtttcttcttttacgccaattgccaaagctttaatatcggaagaaatggaaacacattccttcgtctgatcacctacattattaacaaactccaatatctcatgtgtattcttcataagcccttcaattgaagatgctatttcttccatacttgccgtaatttcttccatcgtcgtagcaatataatttacattttcgctggaactgttcacttctgtattcatcaccccaagagaattctgcattgactccgattggtggtgaactttacgaataaccatctgtaattgaataataaaattattaataccttctgacaattgaccgatttcatcatgtgaacggactgtaatgcgttttgtaagatctccttttttcttgttaatatcatcaataatatgatctaactgacaactggctgcacttgccggtttgcttactgttctcctcataatcaaaagaaccactaccgacaccattataaatataacaaataatattttcgtcacttgaatattcatatcaactgcctgattatacaactttgactgttcagaaattccaccttccagattttccgtgagattcgtttccgttttctctcccatatctctaacaagattttggaaatcggatccaagtgctatacttgcctgcgcaaaatcccccgtatctacatattcctgtattgttgaaaattgcaagagcactttatcaaggaattcttcatatttcttaattgcatcttttaactttgtattgttattatcttttagatacacatctatcttcttctcgctctcagtaatagttgacacttcctctgccaatgaaccttcaagctgttgacgaagttctgcattatcatacaaactaataatattaaggtatttctgacctcgttccatacttttttgaatcgtaaatatttctgtctgaattggaatatactgctccgtgatttctaatccagaccgttttacacgattttgtgatcttacagaagttatcgtatttagtccaaatataacaacaaacagaaccatcattaaaagcactttgctcccaatttttttcataaatagttcctcctatttaattttctccaaaatatttacgcaagaaataggccggtgcacagctccatgcatgacaataactattgacaatagttccgccgtacggggattcatccggattcttcggattatacagctcccagaatgtatctgcaccaagccgcgccataccaccccaatactctgtcaaaacagcaagtgcttcctcatccgcgttgcattttaacaatgcttcaatatagtagtgatacatatacggagtcaccatctcaagagcctccctatctgctgcaacattatgtaaaatccgaagaccttcttcggaatcgactacaccgccaagaatcagccagacctgacttgcataagaaatctgtctattttctccgctgacaaaaagtcctttcttttcatcgtaaaaatatgcttttgctgcctttcgatagacttcataagttccttttaagcattctgcatcacgattttctcttaattcttgtgcaattgcaatcgcactctgcatcgcatacagtaaaaccccctgtgctcccgcctgcttatttaattctagcgaccagtcaagaaaacaccatcctaacacatcacggtctcttacaatgccgttatccactcgtttctgcgccaacgaaatctgtgttcttgcagtctcccacaagtcacgaagcgcctccttgtcttttgtctgcttataataatcccacaaagcaacaacatacagaagtgaataatcaaacatactcgtatcatccacttccggctccggctctaagaatacacaggctccaacctgaccgttttccatcggtaaggccccaaacagatacagacatccttttaccatatcattcatctgataagtctcgtaattggcaagtgcctgcagacgaagatctcccatccagagtctctggtcacgttttggtccatcctcaaataccttctgcatacaatcatgcagcgtattacaggcaatgcgatcaagctgttccaattccttattctcgctatgatatgcggataaacggctatcatctgctgaagacaacgcaaccgcttttgcctcttcaataatcaggtcaaatttagagctgacatcaagcacttcgattttcacgtaacgaaacgaatatcttctgggcagaaaatattctcccgggacaagatcaatatgcacctgttcctgctgcacccatgccgaacagatccagccctgataatcttccacccgttcctcgaattcctttttattttctgcaaacgagaaacgaagccataccggagcatccggatgtgaacgaacataccccaactttaattttatgtgccccacaagatgtcgaccaaaatcaatttcaactgaatctccctttttaagaggctttaaaaaagctgctatatccagaggttcaaccaccgtttcttttacttccggtaacagctgcaacgctttatccaacaattttaaatttttcaccataacttttttctctcactcttaccacttcaagtactcttttccacagaacgggtctactggattcttaccagtaaatgcacttcttcccatgattttttccacaacgctttctatcacatactcactgttagaatatccgttgatataggttttgatcatcggcacatctatcagatgatacggatttgcgaggctgatgaacatcaccggacgttccgcaacaaaccacggaacattgtttccgtttccccagaatgtgtaccaggaaagacgattggtcactttattggaagcattctcaacatttcctatatagataacgagatcataacttttcttaaacgtcccgacatcaaattttgcagtctcgaaattctccggttcatatatcgttacatcaaagccttcttttaccagtttgcttcgaaaactctccaacactctctcatttgaagggaaatctcccataatctcaagcagtactttcttcgttttccgcggactcagcggcaagatcttctgtgtatccttaaccagcgtaaccgcagcattggcactttctttcgcccatgtgacatgttcgtccgaacgcatcacacgaagtgcttcttccgtcggcacaatctcactctttgctttcttataaagacccagcgcagccttagttgcaagaattcttgtgattgcctcgtccaaacgctgctccgacagaattccctgcctgtatccgtttaacatataccgataatcttcgtccagatctttattaaagaggaacatatcacatccggcttcaattgcataaggcaccgccttctctctttccattgcacagctaaaaccaaccatgcaggtagaatcggtaacaatcaatccgttaaatccaagctttttacgaagcaagccttttaacagttccggagaaagtgttgcaggaactaacttgtccggaaaatccggattataagctttctggtatgccggctgtgcaatatgaccgaccatcaccgtctgcgctcccgcctgaatcagtccgctgtaaatctttccgtaggttgcatcccactcctcacaggagagactgttcacactggtaagaatatgctgatccacctcatcgcagccatctcccggaaaatgtttaattgcaacaagtacattttcttcttttgcagcctttatataattaacaccacatgctaagacccgatccggatcgtcaccatatgtacgcacattagtaatcggatttctccagtttctatcaatatcaaccactggtgcaaacgcccagttacatcccaccgctgccccctcgctgcaacttacttttcctaaacgataggcgtcctcggtatctccggttgcagctatctgcatctgttttccgtactgtgttccatccgttgcaattccacatccaccatcctcaagattagctccgaccaaaagtggaattttactatgttcctgaagataacgatgtgttctctgcatctccttagcctcaccgcaccgatacatgattccaccgatatggtgtgaaagcataacatgttccagataatctgcatctcctgaatatccgatcggtacaaataactgaccgattttttcttctaacgtcattgctttttttgtattttcaacccactcgatatcctctttcacaagaaagaagggtgcctttgtcaaattgatcatatttctgtcctccatttgttaagcatcagttatttaaggttgcattcagcaaagactgacgctacatgtcaggttttttgtaaaaacttgacgcaatttatttgcgttttccggtaaacacacgaatcaataaatgttcgttactcagataaattaggaacactacaagcaataaagcattaatgattgcctgcatggatgcatttacttcatttgagaataccgcaaatgtggaattcaacattgacatacataaagctgcaagtaaaaatccaatcttttcattggtaaatctgctgatataagatccaataaacattggaagaaatgcagtaaacataatactgatagatccaaagttaagctgacctccattgatggttgtatttctggaagcgtttaaaaagccaacaattcccatcagcccaccgcagatcacataacaggcaattgcatttggaatttctttaattccggtattaactgcaaccttctgaccattcttaagtgcgttataatcgtatccgaattttgtataatcaaagagtccaataataattaccagtaccgccacaataataattgctgcataaagccagtttcctgtaaaagcagtcatggatgaattctgtacctctttcataacgtaacgaccttctgtaattgtaaaaagaattccttcataaatcagtgttacaccaagagacgtaataattggtggcaaatgtaaaaccacatacaaaacaccggaaatcagtccaagcagcataccaaataaaatagtaagcatcagcattatcggtgcactgccctgacctccacctaaaaacgaatatgtaatctttgcaccaatcacagaggaaagcaatgccattgatcccaaagaaaaatcaaaacgtccactgttaagattgatggacaaagcgatagttgtgatcataacaattgcaatatagacaacaaaattgtcaaagcttgtcatattcatgatcattgtttttccttttgccatacaaataccctgtaacaaaatagccaccagtaccggtatggcaagtgctcctgctaaattttttatacaaagtctgtttttacttttcatgttatcttctcctttctttttacaggataatttttcataccctctcccaatagatgaaagtaataaattcatctattgggagagggtgcggcttctttaagaagccgcgaccaaataataaaaaacaagttaattagatgcaaccacctcattgatagtatcaaaagtaactgtatcaccaataatttgatccaatgtatccctactgtaaatcgggttatcaccattatcattcttgtaaaatttatcaaatgtctcactatctgttgctacctgataattttggctgagtgacacagcatttccctgcgcatcacgaattacattcccattgattgcattcatcactaatgcaaaagcaggtcctaccgatgatgaatattttccagcaagatatacaagctttccgtttgtgattgcctctccattactcttggtaaaggaatcaatatcagaaaactcaatacctgctgcattcaactgctgtgtaaagaatgttgttgccattccgacagagatgaatgcttccggagccgcctgaatggctgcattgatctcgtctgttgttgtatcaccatatccctgtaaataagatacgatcttgatatctcctgaaatctttgacaaatctataccctgatcagcaaaaatcaaaccaactacatcctcttcagttgtcgctccgccataagaaagtccaagtcctgcaagtacgccggctgtacgatatacgtgcattggattcggaataaatgcgccatagattgcagcagtcttaatgcctttatccgcaaagaacttgcccatttctacaccagcttcatactctgtatccatactcggacccacctgtccaagaaaatattcatctgttttatatttttcaaactgttcctgatcaagtgttcctgctgcaactgcataataaatcttgttttcctcacatgtttcaatctgtaatgcacgatcattgcttgaaaaagaaatgactgcctgatatccctgagaagcaaacttctcaattgcagatttctcacttgcagcatccttaagttcgtctgtgtaagtaaatgttacaccatactgatccgcaatataattctcatagtaagaacggaatcctaatgcttcctcaccactgacatcctgaaccagaacaccaatcttgacatctcctgtcggctttttttcctcctgtccatttgaaacatttgtatcatttgttgcatccttactgtttccacatccggccagcattgtcagagacatagctgcaacaagaccaaagcttaacatttttttcattgttcgtttcataaatttcttcctccctgttttcttttaaaatttatctttaacacacaatgtgttaaattcttgttttatcgcggtaaagtctgcgaacgatagttaacgcttgcaacatatactataatcagaaaaaacactgcacttacaatctgcgtaatgccatatcccgatgtagaatcaatgagcagatccaaaatattatttaatacaatataagagaatcctccaacaactgccgcgtaaatctttgatctggcaccacctgaaatcggcattcctccaaatacaattgcaaccataatattcattccaatatccccggctgtcgttgttgtaacagatggtgtatataccaatgtcataaatgcaccgattcctactcctactcccgccaaaaggaagcccaatattgcatatgtgttatatttaataccggaaagctgcgcacagattgggtttccacctacaaatttttctcttcttccaaactttgtataatcaaaaacaaatacacagatcgcaacccagattaccagaactccaatcttaaatgccgagttatccagatgttttacaacctcgcttggaatactgattccaccaaccgcaccaccttttgtcgtaataatctgcgatgcaatcgcggataacacggacatcattgctaccgttgtaacaaacaccggaatatgaaatatggacgcaagcactgaattgaccagtgagcaaacaattcctgctaataaaatcacgataatcatcaacgcaaaattttcagttgcattataggtaagtactcccagcgtggccgcaaaaagcgttgcggctcccaggctgatatcaaatgaacccagtgtataaataaaaattgcacctgttgcaacaattgataatacaatcccttcattaaatacaatcttaatatacatatccagacgatatcctttactgcttacaattccacaaaatactgcaagcaatacgacaagtgctacaaaaggcaacgcacttatcatcatttttttatttttcgtcattcttttttgcctcctaaatcatatattcaataatctgtgcatcagaaagagtttcgcttctctcaaattccgcagagacctcaccatttttcataattagaatccgatcactcattccaatcagttccggtaattcctcactgatcataaggattgattttccctcatttttcaatctcaccataagctggtacattgcctgttttacaccgatatccacgcctcgtgtcggacagtccagaataaggatttcacttccacatccaatccattttccaaatacaaccttctgcttatttcctccggaaagctgtgatactgactgatctcttcccgcacatttgatggacaattcttcaatctgatgattcacatattttttttctcgatttttcagaatcagaaaattattgatcgcaaattcactcattcctgcaattgaaatattatcttcaatacttgcattaagacataacgactcaacatctctgtccttcgatacataacccacacgtttcttcattgcaattgccggactgtcaatgatcgttccgtcttccaccgtaacgcttccctcttccggctttaatgctccaaaacaaacctttccaagagaatgcattccgcaatgtgccaatccaccgattccaacgatttctcctttatgcacctgaaatgaaatcccttttaaccggtcttcatataccagatttcttacatccaatgccacttccggctgtgaacttgcctgaaagtcacttcgataataatcaccttgcagctctcttccgatcatgctcgcgcggattgctccggcctcaaattctgctttttcaaatgtccggataatcttgccatctcgaagaacggtcaacgtatcacagacttccataatttcatccagatcatgcgaaataaaaatcactgatttattttctttacggaagcgattcataatgtcatataaaatttctcttccgtcatgtgataatgctgtactcgtctcatcgattaccagaatctgaggttctttcatcacaactttagcaatctctacaagctttctggtttgaaaatcaagcttctgcataagcatttcgcctgttacatcattgacaccgatatttttcatcaccctggtcgcatccgcattcattttcttacgattaatcaggccgaacttattcttatacttttcagactccgcaaggaaaatattctcagctaccgtaatccccggtattgttccgctctcctgaacaatcattccaattcccttgtgaagtgcatcgatcatgctaagcggcttccagctctgtccctgaaatgtcatcgcaccgctgtcacattcctgcattcctgctacaatagaagtaaccgttgactttcccgatccgttttctccaatgagtcctcttatttctcccggatatacagtcagtgatacatcattcaaagccactgtacttccaaatttcttattcatatttgcaactgttaaaattggttcactcatttttatcacctcgtctttatgcttattatagatttttgttaatttttatgtgattttgttttttatctgtttcactcatttttttaatgtgtttttcttttttctatacgtttaccttaaatttagtctcgcctctaaaaaatagattaaaaatcctatgtttttattgatttttgtattgcatatatgttttaatcaatatagttacctttttatatgaaatggaggaattttatgtcagagaactactatcttatttccgataacgatgtacacatgccgatccggtgtacgatgcagcgatttgatcatatccgccaacagatgcatgattattttgaattgtccatgattgtttccggaagctgtacattacaatttgatgatcatatgtacagtctcagggaagatgatattttttgcatcaatccacttacacttcatgaactacatggtgtcaattgtgtcatcataaccgttctgtttaatcaaacattatttgaacagattctgccggttccatcacatccccgcttcttctgtattagtcccatgtcggataatcaggaagcaattgcacaattacgctctctgattgctcacatcatcaaaacaaatgtggacaaaaaagatggctacgaacttcgcaactggtcatatatctataatgttatggatattatgtaccttcatttccgtgtaaaattatcgactgcaaatgaaaagaaaaaccacaaatacgctatccggatagcagaaatatcacaattaatccaacagcgctatacagaaaacataaccttaaaagaacttgccgatgaagttcatttgtccgttccctatctttcaaaattcttcgttgactattttgggatgaattttctaagctacctgaatcaataccgccttatgcatgcgatgcaggaactttccataacagataaaaatattgatgaagtagcgattgacagcggatttcctaatagtcatgcctttgtaactcttttaaaaaaagaatatggaatgctgccaaaagaatatcggcgcgagcaaaaaaaagaaaagcaacagacctctcaacaattagaacaacataattatattgcaggattaaagaaatatttaaacgacaatacacatacccacgtcgtatcccctatatcaaaaaaacaaattgatttctctgtaaatggaagttcttacgtattgctacatacatggaaaaaaatgatgacagtcggtcgtgccagtgatgtgttaatctgtgatattcaggaaatgttgaccagatttcaaaataggattggatttgaatatattaaattatgcggtatattttcagatgatctgcatgtgtacaatgagaaagcaaacggtacacctgtgtacagttttacatatattgataaaattcttgattttgtaaccaaacttcatcttaatccatggattcaactttcttacatgccggaaaagctcgccaaatatccaaataaacgcttgtttggttctaatgtcagccaaccccattccattgccgcatggtgccggcttgtttcagagtttctgcaacatatcagcaaccgctatggacttgaggtaattcgctcatggaaattcggtctttggaaccagcccaacacaaacatggatcttttcggattttcaaacgaaaaagacttctttcagttttataaggaaactttcctttgcgtaaaaaatttctgtccggatattgaatttagtcttccgccgacttactacatcgtatccgaaggctacgaaaactggtatctgaactttctggaatggtgtaaacaaaacgactgcatccctgacagtttaagtttcacttattatgacaccaaactgatttccaataaaaatcattcaaaagaatctttcggtttcatatatgccatgagtttatcggaatcaccagacggactcaaagattttgtcatgcaggttctcagagaacgacgccggctaaatcttggtaaattgccaatctacttatccgaatggaataatacaccaagccaacaggatctactgaatgatacctgcttcaaatcctgttatattgtcaagaacatccttgaaaactatgaccgtctggaaagttttacttatcaggcgctcacagatcttatggcagacagttctttaccaaatatgttatttttcggtggacttggtctttttaccgtaaatggaattccaaaagccagttattatgcctacacacttcttcaacaattgggtgatcagtttcttgggcgtggagacgaatattttatcacccgtgaaaatgatagttttcaagtcatgctttacaattacaggcattttaattacttatatgcgaatggagaacgttttgatatgacagaaacagaccgctataccgtttttgctgattcggaaccggtaatgatctccctgtgtttatctgatattccacagggaaactataagatttctgaaacctatgtaaatcgaacgcatggaagtgctttcgatcaatgggtttctatgggtgcattggaacttactacacctcaggaaattgattggttaaaaaaatcatccgttcctggatttcatcagaaaattgtgtctgtcaactccgatgaaatcctcgaactggatgtcacattagaattgttagaggtacgattaattcaaattacacctctccactgactttttcacaacttatcaatggaaagcagatccgaaaatgtatggattggatatgtcacatatttatgactcgcggcatctccaatccctgcacttatgaatccaccggcataagccgcatcaattcctgcaagtgcatcttctacaacaagacaattttccggcttttcctcaaccatttccgccgcttttataaaaacctccggatccggttttgactttgtaatgtttgttccatcgctgaccgcgtcaaaatatccatctaatccaatttgctttaaaatcttctttgtattcttactgcttgatccgattgcaagcttgtaaccgcgctgtcgcaaggtgtccaacgtattttttacttcatccgaaagatcccttggagacatcttttccaatagacgaacgtaactttcattctttcttgtagcaagctgttctttttcttcctgtgtatagcatcttgatgctcgctccaaaatgatatcaaggctttccatacggcttacaccccttaatcgtccattaattttctcatcaaaatagattccttctgcatctgccaattctttccacgcctgatagtgatagttatctgtgaaacaaatgaccccatccaggtcaaaaataatagcacgtatcgtatccataaaacacgcctcctttttcatttgcttcaccataacaaaaataaggacagctttttagcctctgattagaccaaaaaactgtccttatttgatatttttatttttgatgtgttatgcgataagatctcggtgtcataccaaatctttttttaaattgcctgaaaaaataactctgattctcatatcctacatcaagtgaaatatcttcgattgacagatccgtttcctcaagaagtttgaccgcagcctgaaatcgcctctgttgcagtaaatcctgaaaatttgcccctgtcttttgcttgatcagcttacttaatacggtaactgactgatgtgtatctgctgcaatctttgtcaaatttgcatttttacaatcactgttgatatattcaagaaccgactgcacaatagtctccttgtaatccatagaagaattatggctcaaattctccaaatgatttaacaaatacaaaaagacaagtcccatggaatactgattgataacatcttcattcatatattcataaagcatggattctatcatattctccatcagattttcaatctggggattctcctttaaacgaaaaatcagataatgaggaaccggactcttctgccggaatgcccctgcaatgaactccgctaaaacatttttttcctgaagcattccaagcggaatttcaaaaaattccggcaaagcaataaaattgattccaatgtcttcaaattcagctctgtgaatcgcatgttccacatactgattgagcatcagtaaatctcctttataaagtgttaattcttttccgtcaattacatgtgtaatctccccctgtaccacatacataaattccacataattatgccggtgcaacggaaattccacaaatctgctgtgacgtcttacagtaatcagttttccccttctgagcagtttttgacgatcaatctcctgtatggacgcttcgctgtataactgttcctcaatcgctgcctgtcctgccttatatttactttcctcttctgatatctgcataagttcatcaagaagttgttgtctcattccttcttctccattaaatacccggtcaaagtctgcatcaccagattttgacttaaaagggggcatgattcaaagaatcataccccactatttacatgccattaccaataaacagcttactattgatttctcaatgtccttcccacagaaaccgtataattagatacaaccgttgtcttatcggaaagtgttgtggttgcctgtacaacaacagaattgatattgacagacattcctgaagtaacggaataacttgcgcccggtacactcgatccggtgacggtacagtctgcaatcactccgccatccattccctgaatgctcaggcagttctttgccagatccagtgccgtcttacagtttacggtagatacggtgcgatctacactgatcactggatttgcctgactgtcggtaacttccagatatcccgtagttgtagccagtgatgtgctctgtccatcacttggatagaacttcagttccagcagataagtacctgtctgtgcctttgtcacaacatttccattcagtgaaaccgcagaaatcggaatttctgatccactgccaattgctgcaggttctgttgaagatccaccctttgacagatcacttccataatactgtccacccttactgatccttacagatgcaatattcacataccgatagaatacgcctccgcgatactctgccagacgcagtgttgtcacttttgatgcaagcagatccgatgcagatgctccagaagtaattgccagatcaatgaccggtttgctgatatcaaccttataggaagatgctccattataaggaggagtctgtacaacaacggtaacattaacggatgccttatgtccgttcattgtcagggtcagggtataattgtaaacacctgctgctcttccggatgcgtcaaataccatacggtcggttgtcggatcataggtagccatagatactttattggtactgttttctacgatctggtatgtctcattctcgagtttcagactctgtccatactgatctcttccctcaatattgacatattccttataccctgttgcataagcgtttgacatggtaatctgcgtattatctgcagtcagtgttgcaaggtatgccggttccgccaccgtaatctcgtatacataagtgtattcctgctttgcataggttgcggtaacgataatatttgcggtacctgtcttgattgctgttgcataagcaacattgttctttccaggatttacaagcaatgtgtccggatcggaagactcaaacttgatgctgtcatacttcatctcggtattgtctgtatccaatgcccggaaatgtacataataattgctgccggatgctacattatgattgtccttgtaactggatgcactgtaatttggcactgcttccgaagaggtaagtgtaaggtttgtgttgtttgacacactggctgccttacatacaaaggttccgcttccggtcagtaccagattcggatcgcttgcacatttataagtcagtgtaaccgttccggtatctcccactccggtcatataaatcttattatcctttgtacggtaaccatttgtaatccgttccgtataagtaatatctcccggatatgctgtcttgacatcaattccgtttgcatcaagaatctcgtattcgattggtgtctcttttccgacggtcacttctgttgtcacaactctaaggctgaccggtcttcccacggatgcggtaaagtcatatgttgactgtccatcggtaaccgtataggttgcaccgtctttcagctgattataggttgtaagaaatacctgtgttccgtcatcggaaaatacagccgacttgatttccatctttgcacctgcctgggtccggatagaaaaatctcctgttttcacaagatttttggcatttccggaatatacagccgctaccttgtttgctgccatctgtgcaattccggtcatggaagttgcgacagtgataaccttgctgtcggaaaccactttatttcccgctttggcctgcacggtgatggtataagtaccttcttttgccggagtaaatgcaccggtctttgtaatcatggacgaaacatcatttccgtttccatccatagcggtccagacattggtgctgatggcatttgccggagtgatacggaaccggaactgataggtctgtcccacctgatatttcaagactccgttatctacaatggaaattgttttcggcagtattttaatcttggcagactttgtcttgatcgtgctcacgcacttcttccctttgtaaacttttgcagttacaattacggttttattctttgcggctgcctttccccgggtgcggattgtcagactgtttgcagatgtctttccgctcacggatgtcgttgttttcttcagctttgcataactttttccggtgccggaaaggctccattttaccctctgccctttggtaagattggttacggtatatgtatacacacccttaccggtgctgttttcataaagaaccgtataattttttacaaatttcggttttgctgccgcatctgcctgtactggaaatacagaaataatcattgccagcgcacacaatacagcaatcagttttttgctttgcaaacgcataatctctcctccttatctggttcactcgctacttaagaacaacgtccttttgtcttatattagcacaccctctgtgctttcgcaattgttcagacagagggtgtttcttaagatttttttaatccagggcgatcgcttcttcttcccgtctccggagaatatcatattcatccggttccatccccagatccacataaaagatctgctgcggatgcggacaggattccatcggctctcccttttcatccatcagtccccgcaccgtaacggtcatattgcgtccgtccggtttcatcacttcgatctgttctccgacagaaaatttattcttttgttccacccggtacattcccttttcatttttcggaccgacaattcccagataggtatatcccttttcatacgtgttgttatcgtaaatctgtgtctcctccgaaggttttccataaaaaaatcccgtggtaaactggcggtatgtgcagcttttgatctgttcgagataccatggcatattttcctgatatttctccggagactccagataatcgtcaatcgccttacggtaagtacgcgccaccgttgccacataaagtgcggtcttcatacgtccctcaatcttaaaactgtcaattcctgcttccagaagatccggaatatgctcaatcatacacagatctttggaattgaaaatataggttccgcgctcattctcatataccgggaaatactcacccggacgcttctcttcaaccacagaatatttccaccggcacggatgtgtacatgccccgcggttggcatcccttcctgtaaaataattggacagcagacatcttccagaataggaaatacacatagcgccatgtacaaatgtctctatctccagatcatcggaaatgtgttcccggatctgccggatctcccgcagggaaagttctcttgccgttaccacacgggtagcaccgagtttctcccagaactgaaatgttccgtaattggtgttgtttgcctgtgtactgatatggcggtcaatatccgggcatacttctccggcaatcgtaaagattgccggatctgcaatgatcagagcatccggccggtccggcttcatgttctgcagttccgtaagatattcccgcgcaccgtcaagatcataattatgtgccagaatatttgtcgtcacataaactttaactccccgtgcatgtgcaaatgcaattccctctgccatctcttccatggtaaagttttttgccttggctctgagtccgaatgcctctcccccgatgtagaccgcatcggctccataaataactgcaatttttaatacttccagactgcttgccggaacaagcaactcattctttctcatcgttttctacctctacttttgtactgactgtaattccatctcccaccggcagcaccgctgttaccagatctttccggtgcgttaactcatacaaatattcccgcatccgtttgtaaatcgtccggtttctgcggatcaccgcataatgggactcaataatgtccccatcctgcagcacattatccgagacaagtgtccctccggttttcagcagacgcagaatatccggcataaaatgaatatactgtccttttgcggcatccataaagatcagatcaaacggctcggtgagtgtcggaaggatttccgctgcatccccttcaagcagtgtaatctgctcttctttccctgctctcttaaaattttcccgggcaatcgggattcgcttttcataattttcaatcgtgacaatttcacacggtaccggatcatattctgccatcagaatggaagaaaaccctaccgcagtaccgacttccagaattctttttggttttgtcatcgccagcaaaagcttcaaaaagctctgcatctccttccgaataatcggaacataggaatccagagcttctcgttcgacagcatccaaaattctggtatttcccgtatccagggaattgatatatgttaccagtcgttcatctactatcatatttatttctattgtgcctccgtgctttccacatcctgcgtatccggtaccatctgcttttctgcaaagaaacgatacccgtaatcataacaggtcctgcataaatgaacggttccatataaaatcagcaggatcagcataataacaaacgcaattttaatgaaagtgaacaaagctttattcataatacccctatacttccatgataatcggcatgatcatcggacgtctcttggtctctttccagacgaaatcacccagagcatcttttacttcatttttgatcttgccccaatcggtaatgttgtgatccatacaataatccatggtcttatcgagaacggtttttgcttcatccatcagactctcggaattacgtacatagacgaaacctctcgatacgatatccggtcctgcaagtacctgtccggatccgttttcgagtgtcatgacgacaataataattccgtcttctgccagacgctgacgatcccgaagaacgatatttccgacatctccgacaccaagtccgtctaccattacattgccaaccggcacatgtccggtcacttctgcaccattctcatcgatctcaagcacatctccggaagaaaggattttgatatgatcactgtcatatccaagctcttccgcaatcttcgcctgtgcaatcagatgcttgtattctccatgcaccggaatcgcgtacagcggatttaccagagaataaatcagcttgatatcttccttgcacgcatgtccgctgacatgtacatcttcgaaaatcacatctgcacccttgcgcatcagttcattgatcacaccggtaaccgatttctcatttcccggaatcggatgggaactgaatacaatggtatcatttggcttaatggtaactttgcggtgcatgccggatgccatgcgggacaatgcggccatggactctccctggcttcccgttgtaatgataaccgtcttttcatccggataatttttcagctgatccacatcaatcagaatgttatccggcagggaaatatatcccagttccgaagcgatggatacaatattgaccatgcttcgtccctcaatcgcaacttttcttccaaacttgtctgcagaattgatgatctgctgcacacgatccacattggatgcaaatgtcgcaataataattcttgtatttttatgctcggaaaaaatgttatccagcgtttttcctactgacttttcggaatctgtaaatcccgggcgctccgcattggtactgtcacaaagcagtgctaacactccttttttaccgatctcgccgaaacgctgcagatcaatggcatctccaaataccggtgtataatcaaccttaaaatctcctgtatgcaggacaattcctgccggggaataaatcgcaagtgccgccgcatcctgaatgctgtgattcgtgcggataaactctacacggaaacatccaagattgatgtgctgtccgtatttgacaacttttctttttacttttttgagcatatcatgctcttcgagtttgtgctcgatcagggcattggtcagtctggtcgaataaatcggcacattgacatcttttaaaacatatgggatggcaccaatatgatcctcatgtccgtgcgtaataaaaaatcctttgacacgatcaatattttcctttaaataagtgacatccggaatcaccagatccactccgtacatgtcatcttccgggaatgcgagaccgcaatccaccacaataatactgtcttcgtattcaaaggcagtaatattcataccaatctgctcaagacctcccaacggtataatcttaagcttactgttattctgtttttcctgttttttcataaatcctccaaatataatattccgctctaatataaaagctgtgtttcttcatccgcaagttcagcaaatattttcgcgagtgcagcaaactctgtatcatcatctaccatctcgtaaaatacttcctcatcctgtgtctttatttcttttaatatatatgcttcactgtccccgttttcattgccatcagagacaagtaagtatctgattccattcagctgtgtctgttcttccacagcaaattccaccacctcattggtgtccggatctgtaaactgaattttttccatttattttttccttgtatttttatttttcttctggatgatttgaaagataatccagatatccctgtaatataaaaatagccgcaatttcatctacatattccttgcggttttctcttcgaattcctgtttccatcatcgaacggtctgctgcaactgttgtcagccgttcatcccataaaataacagggagaccacagcgtttttcaagcatttccttgaattcttttgttttctcgcagcgctccccttctgtactgttcatatttttcgggtaaccgagcacaattttttccacctcgtactcgcttaccaactgttcgatccgcgccagtgtctgcctgagtttcgttggagctttccttcggataatttccactccctgcgctgtaattaacagcgcatcactcactgcaacacccactgtctttgaaccgaaatccaatcctaaaatccgcataattctcccgtaccggattattcccaggaattgtttttgatgtatgcacgtaaaacttcttctacaagttcgtcccgctctactttcatgatcagacttctcgcattgttatgactggtaatatatgtcggatctccggacataatatatcctacaatctgattcaccggattgtatcctttctcactcaatgcacggaatacgatctctaaaacatctcttacctgtaattccggttccttttgtactgtaaaatattgtgtattatttaaattctccatattcgccgtccctgcccttgttcattccaacaagtcctgtcccatctattgtatacgaaattgaggaaaaatacaagcgctatagtttcatacgataaatctcatcggtcagagccgcttccactcttccccttttcatcacattatcaagcggttctgccgtttttgccgcgatctttacatactctttggtatatccagtataccacgtttctccgtcaacttccattggttcctcaaagagtacttcttcctcttttcccacataatatgcgcggaattccctcgacatactttccgcaagtgccagcagctgggcactgcgcttcgtcttgatttcctccggcacctgatgttccatcactgccgcacgggttccctgccgtcgggaatatttaaaaatatgcatctcataaaaatgaatgcgttttaaatattcctttgtctgtgcaaattcttcttctgtctctccaggaaatccaacaataacatccgttgtgattgccggatgcgtaaagtttttccgtaaaatattgcatgcattttcgtattcttccgtcgtatatttccggttcatccgggcaagcgttgcatcgcatccgctctgcagtgacagatgaaaatgcggacagatcttctccatctttgccagttcttctgcaaatgtttccgtcacgattctcggttccagcgatcctaaacggatacgccggattccctccacctgatgcaccatctggatcagatgcagcagactttccccgcagtcaatcccgtaggagctcagatgaattccggtcagtaccacttcctgatatccggacgctgccagacgctttacttcctccagaacattctgaacatttctgcttctcacccgtcctctggcatacggaataatgcagtaactgcagaactggttacagccatcctgtacttttataaacgcgcgggtatgctctgctgcatgatccagtgtcagctcctcaaatgcctgtttttcgtggttaatatccaccacagcctccaccttttctcctctgcccgcaaagaaagcatccagccgctctaccagctcttttttctgattatttccgatcagaatatcaattgcttcatcacattttgcctcatcctctttggtctgtacatagcatccggcagcaacaacagccgcatccggattccgcttttttgcccggtgcagcatttgtcttgatttgcggtctgccatatttgttacggaacaggtattgatcacatagacatctgctttctccgaaaacggcacgatttcgtaccccgcttcttcaagcatctgctgcatagcttctgtctcatatgcattcactttgcatcccagattgtgtaatgctgcttttttcatttttactcctttatacaattatcttcatacatttcttgacttttccaataaaaaatattactatcaaagatataaacagcatgagtttttcatgaatattttcaaggaggttttcattatgaaaacagtacagatttcattaaattctattggaaaagtaaaatcatttgttaataccatctctcagtttgagtacgattttgatctgatttccggcagatatgtcattgacgcaaaatccatcatgggaattttcagcctggatctttccaagccgattgatctcgccatccataccgaggataatctgaatgagattctggaagctttagagccatacattatttcccagtaattacttacaaaatcccctgtctgtattgcagacaggggattttttgtttcacggaaataattttccaaaaacagattattctgcatctaccagaatcgtctctgtcgtatcgattgctgtctgcatcagttcgtctattttttcttccagccggcactctgattttttaatatgttttaagcttggcttggtaaccggatgctttgccacgaaaatcgtacaacaatcctcatacggaagaatggacgtctcgtatgtgtcaattttttctgcgattgatacaatatcctgcttgtccatggcaatgagcggacggtataccggcatatgacacacttcattggtcacagcaagggactgcatggtctggcttgccacctgcccgatactctctcctgtaatcatacccagacattttccctcttcggcaaaatgctctgcaattttcatcatatagcggcgcatgatgatagtcagttcctcatgcggacatttctcataaatataaagctggatatcggtaaagttcaccacatgaagcttgatctgtccggaatatcttgcaactttctttgccaggtcaatcactttctgttttgcacgctcactagtgtatggcggtgcatgaaaataggtcgcttcaagtgttacccctcgtttagataccatatatccggcaaccggtgaatcgattccgccggataaaagaagcattgcacgacctgctgtgccaagcggcatgcctcccggtcccgggatctctgtggaataaatattgatcatcgggcggatctcgatatgaatcatcacctccggatgatgtacgtcaacgctggtttccggaaatgcttcaagaatcttttccccaacagctgcattgatctccatcgaagtcatcggataattctttctggcacggcgcgcatccaccttaaatgtaaaatttttgtccggatatgtgcgatccacatagtcacatactacttttgccagggcatcaaatccttcatcttcgaccaatactaccggacagattcctacgattccaaaaatcctctgtaatgtttctacagtttcatcataatcgtattctccttccgtatccacatagatacgtccgttttccttgcgtacatggaaggttccctctacacgttccagatgatatctgatattctgtaccagtgcatcctcaaacagataacggttctttcccttaatggcaatttccgcatatttaatcaaaaatgatttatacatattgctctcctttttctaatgtcttgtatatttctgcagcatcggaaccaatgccgccatctcttttactgcataatcaatctcttcttccgttgtctccacgcaaaagctgaaccggatggttgcatccaaaagctctggctttaagccaatactttttagcgtatgactgacagaaggcttgttggaagaacatgcacttcccgctgacacatagatctctttatcctctaatgcatgaagcaatacttccgcgcgcacaccttccgtgctgacactgacaatatgcggtgcattgctgcgatcggtatgaccgttgacgtgtacacccggaatttttgtcacttcctcaataaaatgctcccgcaaggtatacatccggtcgattttttcctcaaaaccagtataaatacgttccgctgctacgccaagtcctgcgattgccggaacattttccgtgccggaacgcattcccctctgctgtccgcctccgtttaacagcggatgaattttcgtcttgtctttgatatataaaaatccgcttcctttcggtccatgaatcttatgtccgctgaccgagagaaggtctacatgcatttttgccggataaattctcatttttccataggactgaatggcatccacatgaaaaagcgtctgtggattacactgtttgatcagtgcccccgcttccgcgatcggctccaccgctccgatttcattatttacctgcatgagggaaaccagaatggtatccggccggattgccgctttcagatcgtccagagaaatcacaccataagcatctaccggaagatatgtgacttcatatccgtgttcctccagatatgccatcgttgccgacacggacggatgttcaatagacgtcgttatcacatgttttccacttcgcttgtttgcctctgccacaccgataattgcaagattattggactcagtaccacctgacgtaaaacagatttctttttcctgtacctttaatgtctttgcaattttttttcttgcatcgttcatataattttcggcgatcacgcctttgttgtgcagggaagatggatttccataatcctccgtcagtaattttaccaccagctgtgccgcttcctcacaacatcttgtcgttgccgaattatccaaatatgcttccatttttacccttcttatatatccaattcgtatatcagcatggaaagtgttgccattcctgctgtttctgtgcgcaaaatacgtctgccaagagagatccgatgcatgtctttatccagctgcgcaatctcttccggggaaaatccgccctccggaccgatcattactccgatggacgccccttccggaatcgagcgaaagatctctcttgttgcttccatgcctctttcattctcatacggaaccaggacaacgtccagctcctttgcctcttccaatgcctgtttccaggaaagtggcatctgaatctgcggaatcacggtccgcttcgactgttttgccgcactctctgcaattgcctgccaccgcttacatttgctctgtgccttcttttcatccagctttaccacacagtttttcatggcaaccggtatgacggtatagacaccaagttccacggtcttttgtatgatcagttccatcttatcacttttaggaaggccctgaaaaagatacaccttatgggaaaactctgtccccatttcatcggtatcctctatctgtgcccagacctcttcctctgtaatttccagaatacggcaaaaatacgatctgccgctctgatcgctgatgcggattttctcccctgtcttcatgcgcagcacatgaccgatatgattgacatcaccgcccacaatgcagatccgatcctgctgcacctgttcatcttccacaaaaaactggtacataccctgctcctactgtttctgtgcggtaatatttacccactcaccctgatgattgatttccactacagtaagtcctgctgcttctatcgcttcttttacttcgttttccttaaaatcaatgatgccggaagtgataaaataaccaccctgttttaatctggccggaatgaccggtgccatggcaatgataactggtgctaaaatatttgccacaacaatctcatattcctctgtcccaaccttttcctgaagttcttcatcatcaatcagatttcccacataaaaggttcccagagacaaatcgagatggtttacctgcatattatcccttgtagaagtcatgcagtctgcatccagatccgttcccacgacttctcttgcgccgagttttaatgccacaatcgataaaattccactgccacatcccacatccagtactttcggatgttttccttccacatatttctgtaactgccggatgcaaagctgtgtcgtttcatgttttcctgttccgaaagaaattcccggatcgatctcaatcagaaatttatctttgtcttcttcctttaattcttcccaggtcggtttgattaatatatcatcaatggtaaaagaagtaaaatattttttccagttattgatccagtcaagatcttctgtttcggaagatgtaatgacaccgcttcccacttccaccatgtcacgcagtttctcgagtccgatctttacctgctttaaaatctccgtctgatcactgccgtcttcttccacataaaagctcacatggctgatgccctcatccggaggaagttccggcagaaaatcaataaacatatccgcctggtcttctttggtaagcggaatattgtcttcaatctctattccctcaatgcccagatccatcagcatggaactcataaaatcctctgctgcagtcgttgtctcaattgtatattttttccacttcatgttaccatcctctcaattctacactaaggcatactatatgtatcataccttatttccaataaaatttcaagaaaacattgtacatcaaaaaaacccatgttataatataggggttaagttgatagttatacagttataggagaaaacaataaatggataaacgcaatcttgtagaaggacttcagaaagcattcaacaccgatgaccggcagcgaaatacttctgataccagtgatgtagaatataaagagaacaccaatactctctatatcaaaaaacagagaacctacaatatggaagaaaacattccgtccgccactgccatgtcagaggaggagatttttaagcgtcttcatgaggaacgacattaaacatgttaaacatgcataaaacagccatacggtctgcggacagaccgtatggctgttttaatttttgtacacagcacaaagcttatgatactcactgttaatttcctgaacggtattcttatccccatccagattatccggatgataaattttgatcaggtctttataacgtttcttaagggactgtctgctctctactccggagaaaaacatttctccccggataacaggctgctctgctgtcacagaaaaatcgcttacccgctgatagaaagctttctgcttcttcacatgttctttctctgttgcaagttttacaagttcttcttcgagtattttaaatttcatatcaaaaagcttctgctgctgttccagacggcgatcctcattctccacccgccgcgcaaattcttttttctcccgctccagtgtgcggcgctgctcctccaaagctttacgttcttcttccagcgtcatcccccacatgcctccgtatccgtacacacatgttgccaataatactaacagactcatcatacaatactttgtaccagattactataggcgatttgtactaatgttcatcgaaagattctttgattttgtccataaaacccttctttttttcttttccggtctgtgctccgccctctttattcagggaatttcccgtcaattcatcaaatttacgcaacgcctcttttgcctctttgtttaagcccgtcggcgtgttgacaatcagtgttacataatggtctccacgtactgccttgtttcggatcgatggtactcctttgcctttcaggcggattctcgttccgctctgggtacccggtgcaacggtatagatgatatctccatccaccgtcctgatacggatatccccgcccaatgctgcaataccaaaggaaatcgaagcattggaaaatatattcatgtcctgacgttcaaacgcattgcttctggaaacaagaacttctaccagaagatctcctctcggacctccgtttcgtcccggttctccgtaacctctgacacgaacagactgtccattatcaattccggccggaatctctacagtctttcgtactttctttgagatatatcccgttccccggcaatccggacatttttcacggatcaccttaccggtaccgccgcaatccggacaggtctgcacattctgcatcatgccaaacaaagactgctgggaatataccactttcccttttcccccgcacttgctgcaggtttccggtgaagttcccggttttgccccagttccgtgacaggtcttacattcttctttatacgggaactcaagttccttagaacatccaaacacagcttcttcaaacgtaatacggacggtaagacgtacacttgcgccttgcgccgatccgttattgttactgtttcgtcttccgccaccgaaaaagtctccgaaaatatcgccaaagatatctcccatatccatgccggaaaaatcgaatccgcctgcaccgccggcgcctccatcaaacgcggcatgaccaaactgatcatactgtctgcgcttttccggatcgctcaaaacggcatatgcctcctgcgcttccttaaatttttcctcacactctttatctcccggatgcatatccggatgatacttcttggcggttgtacggaaagctttttttatttctgcttccgttgcggtctttggaattccaaggacctcgtaataatctcttttctctgccataatattaatcccttatagtacgcatagggtttccggaaaaccggaaaccccacgctttgtctatttattttctaaattaaacctctttgaaatctgcatcgatgacatcatcatctgcaccatttgctcctgctccggtgtttgctcctgctgcagaacccatatcaggacctgctcccggattcgggcctgcgcctgttgcaccctgtgctgcctgtgcctgctcatacatctttgcaaataccttctgtgcactctgtgtcagtttctcctgtgctgcctttaattccgcaacatctgcatctgtcatctgctctgcttccttgtgtgcatccaggaaagcctttactgctgcaacatcagcttctactgctgacttgtctgcaggatcaacctgatctcctacctgctttaatgcatcctctgtctggaatacaaagctctcagcttcatttctggcatcgattgcttcttttctcttcttatcctgcgcttcaaactcagcagcttccttaacagccttatcgatttcttcatcggacatgttagatccggctgtgattgtgatatgctgctctttgcctgttccaagatccttggcagatacatttacaataccgtttgcatcgatatcgaatgtaacctcgatctgtggaacaccacgacgtgctggcgggataccatccagacggaactgtccgagagatttgttatctcttgcgaactgacgctcaccctgtacaacgttgatatctacagcggtctggttatctgctgcggtagagaagatctggctcttcttcgtaggaatggtagtatttctctcgatcagacgggttgcaataccacccatggtctcgatagaaagtgacagtggtgttacatcgagaagtaagatctcgccggcacctgcatcacctgctaatttaccaccctgaatagaagcaccgattgctacacactcatccgggtttaaggacttgcttggctctttgcctgtcatctgtcttaccttatcctgtacagccgggatacgtgtagaaccaccaaccagaagaacctggcctaaatctgcatttgtaagacctgcatccttcatagcgttctgtaccggtacagcagttctctctacgagatcatgtgttaattcatcaaattttgctctggtgaggttcatatcaaagtgctttggtccctcagcagtagctgtgatgaatggtaagttaatatttgtagtagttgcggaagaaagttccttctttgctttctcggcagcttcttttaatctctgtaaagccatcttgtcggtagaaagatcaacaccctctgccttcttaaactcatcgatcatccactgtgtgatcttgttatcaaaatcatcaccaccaagatgtgtatcaccgttagtagataatacttcgatgacaccgtcaccgatctcaatgatagatacatcaaatgtaccaccaccaaggtcatataccatgatcttctgttctttttcgttatcaaggccatatgcaagtgctgctgcagtaggctcgttgatgatacgctttacatccagacctgcaatctttccggcatcctttgttgcctgacgctgtgcatcgttgaaatatgcaggaactgtaataacagcttctgtaaccttttctccaaggtatccttctgcatcagcctttaatttctgaagtaccatggcggaaatctgctgtggactgtactgtttgtcatcaatggctactttataatccgtacccatatgtctcttaatggaagaaatcgtcttctcagcgtttgtaacagcctgacgctttgccggctcaccgatgagacgctctcctgtctttgtaaatgctacaacggatggtgttgttcttgcaccttcctggtttgcaataacggtaggttttccaccttccataacagctacacagctgttggttgttcctaagtcaataccaatgatcttgcccattttcttttcctcctgctaaaattatgatcaaataaaattgttttgctaatttatgatttactactccatgcgaaataggaaatacctttattcgctgactacagcgaccatactgtggcggaccacattgtccttgtaggtgtaacctttttgtaattcctgggcaactgttcccggttcatactcttcgctttccacctgcataactgcattgtggagatccggatcaaattcctttcccagtgcctcaatcggtttcaccccgatggcatctaattctgtcagcatctgcttatatactttatccataccggtaacaaaagcatcatccttttgttcctctggtacagctgcaagcccacgctcgaaattgtcgataaccgggagaatcttttcaatgattgttcttgctcccatgtcaaacatctgcgctttttctttttccgtacgtttacggaaattatcaaactctgccatctgacgtttcagacggtcgtttaaatcttcgatctgttcgtcttttttatctttctttttctttccaaaggcaccctttttttcggatttctcttctttctttgtatccttttcttcggctgcagtttcttttgtttcctctgccgccgtctcctttgtgtcctttgtttcttcacatgtctgttcagccttggtttcttttgtatctactgcctcttcttccatgacttttttgttctctgccatgtttaccacctttctaggattgccctttttctttatcaaaaataccgtctaactgggactttaagtttttgaggttgtcaacaacattctcgtaatccatccgtttcggaccaacaattccgatcgttcctttgacgccctcccccagatcataagttgcggtaacgacactgcaatctttcatggtctgtaccggagcttcatttccgatataaacctgtatttcatttcctttgctctccccctcagaaagggattccgttaccagatttaccagctcatctttttcctcaaatgtggaaagaagacctgccgcactctctgaatcagaaagttccggatatttcaaaatattggttgcaccgcttgtgtagatctgcagatcctcgttttcactcagtgtctgtcccagtgcatccagcacatgggaaacaatctcactgtgcacgcctgcctgctctttcagtttggaaatcgttcccagattgatttcctgcagtgacagcccattcaatgctgtattcagcagaatgttcagtttcagtaacgtttcgttgtcgagcggttcttccacgtcgatcatctgattctttaccatgttgctgttcattacgataactgccagtatatgtttctcatctacattggacagctgcataaactttactttgtttccactgtaagtcggtgcggaaacaattgtcgcataattggtgttgtttgcaagcatctttgcaaccttttttaatacctcatccatcttctgggttttttctattacgaagtccttcatttctttgacttcccggtctttttcctgcatcagatgatccacataaaaccgatagcctttgtctgaaggaattcttcctgctgatgtatgtggctgcacgatataaccaagttcttcaagatctgccatctcattgcggatggttgcagaacttaaattcagatccgtatattttgaaatggttcgtgatcctacaggttcaccggttgcaagataattacggataactgcatccagaatttttacttttctttcatccaattccatattctcgtctgccattttcccgtctcctgttcctgaaccttcaccggttgtttttggtttgttagcactcatttacttagagtgctaatatcgttctgttattaaaatagcaccaaggtgtttttttgtcaacaccctgatgctattttatttttattttataattatattttataaaagaaacttcgccatcacgtagttggccagatccatccccttgtcggtcagtgcaatcctgccagcaaccatctgcaaaagtccctgttctttcagcttgcgaagtgtttccagatacacggcctcaatcggtaccccaaagctttgctcaaacgctgctctggttactccctcattcatccgcagccccagaaacataaattcctccatctgctcttttcttgtcagaatctgtgcctgttcctgtacacagctgccaatccagagatcctccggtacggcatgctccccgtcttttaaaaactctgccggagacttttcctgcaggtggtcacaaaattctccatactcatacagctgccgggtgttggtataccggacattttccaccagggaagatgcccccagccccagccccagataattttctctggtccagtagccgatgttatgtctgcaggcataccctggctgggcaaaattggagatttcatactgccggtatcctgcctgtttcaatacatcctgcgtggccttataaatgcggtatacctcatcctcgtccggaagaatctctgtatgaatccccgcttcctgcttcactgcgtcaaacttataccgttcataaaacggtgtccccttttctatgatcagggaatatgccgaaatatgttccggtttcaggcggatcaccgtctgcagggattctaaaaatttgtccagcgtctggtaaggcagaccgctcatcagatcaatattgatattttcaaatcctgcatttctcgccagctcatacgtttttaaaaactgatcatacgtgtgaattcttccaagtgctttcagctcctcattgtttgttgactgcaatccgatcgagaggcggttgatccccgcactctgatagacattcagtttctttgccgtcaccgttcccggattgcactcgatgctgatctccgcatccgcctccacatgaaaactcgaagcaacctgctgcagcacggtgtaaatcagattttcctccagccagctcggcgtgccccctccgatataaattgtcgggacatgataatccccaagcagatttccgtaataacggatttcctgcagcagggcatgcacatatctgatctgtgtattgctgtctgccggaaaggacaggaaatcacagtaatcacactttttcacgcaaaaagggatatgaatatataattccagtttcttttcattcatagaatcagtcttcatccagtttcaatacactcatgaatgcctcctgcggcacttctacgctaccgacctgacgcattctcttctttccttccttctgtttctccagaagctttttcttacgggaaatatcaccgccgtaacattttgccaggacatccttgcgcatggccttaaccgtttcacgagcgatgacttttccgtttacggctgcctgaatcgggatttcaaacagatgtctcggaatctcttctttcagacgctcacacattttacggcctctgtcgtatgcactgtctttgaatacaataaaggataaggcgtccaccatctccttattaataagaatatccagtttgacaaggtcggaacggacatatcctttcatttcataatcaaaagaggcatatccgcgggaccgcgactttaatgcatcaaagaaatcataaataatctcattcagtggcatatcatatttgatcacggcacgggttgcttcaatataatccatgctgatataaataccgcggcgttcctgacaaagcttcataattgccccgacatactcgctagttaccatgatctctgccgatacaaacggttcctccatatattcaatctccgaagggtccggcagattggacggattggtcaggtcaaacacttctccgttggtcttgtgcaccttataaataacaccgggtgccgtagtcacaagatccagattaaactcacgctctaaacgctcctgaataatctcaagatgcagtaatcccagaaatccgcagcggaatccaaatcccagggcaagggatgtctccggttcatactgtaacgatgcatcattgacctgcagtttttcaagcgcatcccgcagatccggatacttggcagagtctgccggatataatccgcagtacaccatcggattgacctttttatatcccggaagcggttctgcacacgagcggtcgagctctgtcacagtgtctccgacacgtgtatcgcgcacatttttaatgctcgccgcgatatatccaaccatacctgcggaaagctcgtcacacggaataaactgcccggcaccgaaatatcccacttctgtcaccagatcctcggctcctgtggccatcattttgattttggttcccactttgacggtaccttccttgatccggcagaaaacaattacccccttataggaatcatacagcgcatcgaagatcaacgccttaagcggtgccttcggatctccggcaggtgccggaatctttgtcacgatctgttcaagcacttcctcaatattcagtccggtctttgcagaaatacgcggagcatccatcgcctcgataccgatcacatcctcgatttcctgtgcgacctcttccgggcgtgcactcggcagatcaatcttattgatgaccggaagcacatccagatcatgatccagtgccagatagacattggcaagtgtctgggcttccaccccctgtgcggcatccacaaccaggatggcaccatcacacgctgcaagactccgggatacttcataattaaaatccacgtgtcccggcgtatcaatcaggttaaaaatatattcctctccatcctttgcctgataaatgatgcgcactgcctgggatttgatcgtgattcccctctcacgctccagatccatattatcgagaacctgtgcctgcatctcacggctggtcagcgttcctgttttttctatgattcgatccgcaagtgtagacttaccgtgatcaatatgggcaataatacaaaaattacgaattttgctctgatcgattgacatcttattcctctttttctttctactataatttatcgtttgataagtacggtccatcagatgctgatagaacctacgcaatgttacattataccgaaaacaggtctataaatcaaacattgacatccactttttccataatacctgtttggtatcatcgtccgcaaatgccgaatgcagcgaagccatataaattttctcacacatcggctcttgaaacatcccggcttctgccagacgcatatattcatccgtacagctggtatcgctgacggtacggttgtccgtattgatggaaagcaaaattccggcatcgtaaaattcccggaacggatagtctgtaaaatccgtgaccgcctttgtctgcagattactcgtcggacacagttccactccgatctttttctctgcaacttccttctttaattcctcgtccccgctcatggcaattccgtgaccgatccgcgatgttcccagttcaatggccgtacggatttcttccctgcttccacattctcctgcatggatggtatatggcatgccatatttttttgcagtggcaaatacgtccgcaaacgctgctgtcgggtacgccttttcatcccctgccagatcacaggcaacaacaccgtttccgagaaattcccgcgcttcttttaacatggcaatatttttttcggtttccagattgcgcatggtgcagacaatcattccggtcaggatgtccgctttttcttctgcttttttcaggccatcccggacgctctctaagatttcccggaccgaaagcccctgctccatggaaaatgcaggtgcaaaacgcacttccagatacttgacctgttcttttgctgcagaaagtgccagatcctgtgctgctgccgaaagtccctccttcgtctgcaggcagccaagcggcagttcaaacttctccagatactctgccagtgaactgcagtccatcggtgccaccagtttttcccgcagttcttccagccccagcggctctttcccctcctgctgcatcagtttctggatcaggggcaggctcatcgaaccgtccagatgacagtgcagctctatttttggcatattgtgtgcaataaatcgattcatcatcggcttttccctctcttctgcaaactataacaacggaagaagtgatgtgccgatcgtatttgccggcatctgcactccaaaattatccgcaatggtcgccccgatcaccgcaaatgtatcctgtgtcgggagcgacccgcttccctgatcggatggcgaatacaaaagcagcggcacctgctctcttgtgtgatccgtgcccttatacgttggatcgtttccatggtccgccgtgatcatcagcagatcctcttttttaagcagtggcataagttctccgagctttttgtcaaacctctcgatttcctctccgtatccgatcggatttctccggtgtccccacagggcatcaaaatcgaccagattggtaaagcacaaaccgcagaaatcggattgggccagcgcaatggtctggtccatcccatggacactgctggtcgaatgcagactttttgtaattccgtatccgtcaaaaatatcatggatctttccgactgccagcacgtcatatccggcttcctgaagcgcatttaatgctgttggcccggtcggtttcaacgcataatccctgcggttactggttctgacaaactcgccttttttctttcccacatacgggcgggcgatcacgcgtcccaccctccactcatcacgcatcgtcaattccctggcaatctcacagtaatgatacagggtctctaatcccatcgtctcctcgttcccgcagatctgcagaaccgaatctgccgatgtgtacacgatcagctttccttccctgatttcctgctcgccgagttcctctaaaatctttgttccgctttccgcccggtttcctataatttttctgctgcatcttttttccagttctgcgatcagctccggcggaaatccatgttccgtaaaggtgatgaaaggcttttttgtttcaatccccatcatctcccagtgtccggtcatggtgtcttttccgttgcttttttcattcagtgccgcataatatccaagtggatgttcctgcggctgtacctgttttaaggatttcaggtttgccagccctaaagatgccagatttggaatataaaaatgttccacggtctgtgaaatatgccccaatgtatcggcaccttcatctccgaagcgtgcggcatctgccatcgctcccattcccatcgaatcgagtactattacaaaaacacgtttcaatcgtctgtccatgatttactcccctccctgtttcttaagattttccggtccaaaactaagaggcagcagttcctccagcgtgtgtacttcatagtcctcctgggaccttgcaagtacaatctcaaaatctcccggacagaattcccgcatcacctgtctgcagattccacacggactgcaaagatccgtacattggttttcctctgccgtttttgggtacaaaacacttccaccaacgattgcaatcgcctgaaattcccgcacaccctcactgaccgccttgtaaaatgccgtacgttcggcacagtttgttgcaggataggaagcattttctatattgcatccctgatacacagttccgtttttggccagaagagccgcacccacctgaaaacgggaatacggtgtatacgcccgctttctcgcctgaaacgcactccggatcagttctttataatctgtctgcatctttatcctcctgtatcagcaaccggatggcatccacagttgtagcgattgcctgcgttgtatcatgcacctgcacgttcggcagcccccttttttcccgctcctgattggcaaggacaagaaagcaggcgcccacacgcacatgcaaaaaacttccggcaataaaaagtgccgccgattccatctccgatgccagacatcccatcctaagccatgcctgccatttctgcgtgagctcataacttaccggcataatctgcggctcatgctgtccgaaaaaggaatccttgctctgtacaacgccgacatgatgacgtatcccgcgtttttttgctgcctgtaccagtgcagtagtcactgtaaaatccgggacagccggatattcgaccggtgcatactcgcggcttgtcccctccatccggatcgctccgtctgcaatcaccagatctccgccaagtatattttcctgcattccgccgcaggtgcctacacgcaaaaacgtgtgtgcaccgcatttggaaagctcctcgatggcaatcgcagccgacggtccgccgattccggtggaagtcacactcaccctgacgccatctaacgttccggtgtaagtcgtaaattcccggttatctgccacctgctttgcatccgttaaaaattccgcaatctttgcacatcgtttgggatctcccggcaggatcacatacttacctatgtcctgcggtcccacgcctgtgtgatactgtctgcctgagccttctgtataatcaaccataaaaatgccctcctcatataagtacattgtaacatttacagccgttatttcaacacttttgcaaacagatctgcaagtggttccatcgcattttttgcttcctcaaacgtattcgtctgtgcgcccacttccaccagcatgctcttcggacaaaaatgcatattaaagcggtacccttttagataaatccgccttgtaaaatccggataatattccgcagcggcaagctgcatctgaaacgaaaacgccagattatcggaaatatacggattttttaaatacggaatatccccggaagccgttgttctgctcagtccgttaaaaaacatgatctttgccatcttttttccgttttgcgttgtcaccagacgcgtgttttctcccacgccgtctctatgtaaatcgatcactacctgaatcgatggattatcatttatgattttctgaatcgacggggctgccttggaatatgcatgatcccggtcgcccacatcgtattctcctttatgatgcatgacttgaaatccttcctcttccaacaattccgtcagataatctcccactccgacaacacccgttttttcatcttttgaatcggcataccgttcctgggaatgggtatgataaattaaaatctgcgggccgtccaccgactggtcaatccttagatccggtttcatcagcttatccacgtccagctgatttttcccgatggtcgttgtattatcaacctgataaaaggtctgtctcagataatcaaaatcctgcagttttttgcggttgacagaaacttttttcccggaagtttctgtttttttctccggctttttggactctttttgtgtcggagtctcgtccacattctgactttcctgctgcactggctgttgcgttaccgccttttcattttccgcaatgatctgctttgcctgttcgttttcctctgctgcctgattctcataatacgccaggttttcctcctgtgattcataccacagccgctgctcgttttgtgcaattgccggatacatggaagccgtcacatcccggtatatattcggaattccttcctcctgcgcccccagtacccccggcacataaagattaagcactccgttataaaatttcagggacagattctgccccagaaactgcaccagtccgccaccccagcaatacgcaaaagcacagaccagcacaaaatctatcgtcaccagaaaaagaagcaatcgtctcctcaccctatcaccaccttgagagaattatatgccttttcttttgtccctattcctctttatctcccagaagcgcaatattgagtccctccgaaatcagaaaacttaaatttttgatcgagtcatcaatgtttttcggtgtgacaaaaagaccattcagctgtggcgagagcagttcccttgccagttcctgccgctccctctcatccagcttctgcagatccgaaagcgataatgcggaaataaattccgtcatggcatccgagacaatcgttgccgcatccacgaccgtcggcacaccgagagaaatcacgggaacgcccacacttttgcggttgatggcattgcggtgattgccgattccgcttcccggcgtgattcccgtatccgtcagctggatcgtccgtcccagccgccggatgcttcttgccgccaacgcatcgaccgtgatcagaaaatccggtttcgtctcttttaccacaccctttaagatctccacacattccataccggtctgcgccataacccccggcacgattccgctgacttttcccacatcttctctctggaatgcgtactttccgaattcattcaggatgtggcgggtgataaataaattatccaccactctcggtcccagcgcatcgggcgtcacttcccggttgcccagtccgacaaccagtgccgcgacttccagccccttttttaaatttttttcaatctcttttcccggcagaagattccgcatgatctttgccagctccaaagaaatatccctgtggtatccggcatcttcctcgatcatctccggcgcctcgatcgtaatgtacgtcccctttggccttcccatcgcaacggatgcattctcagtctcgatcatcacggtactgacaatcactccattttcccgccgttcttccagaacacggatgccgcgcatatctgcctggtcttcctgcagccgctcctgtgattcgagtgccagatccgtacggatcggataactattttccaacatgcctcttcctccccttttaccatatgcatttttgcagaaatggtttctgaagatagtatgtacggcatagatttttttatgcctgaaattaaaaaccgcagggacattcgtccctgcggtttatctgtattcctctgtttccggatcaattatttgccagcgtaaagagttactaacttctttaagtggtcatactcatccttagagttcttctcagcctttgcaaataactcagcagctctctccgggttgaacttcgcaagagatgcataacggttctcaccctttaagaatgcctgataatcgcctgtaggctccttgctgtctaatgagaatgcatctttgccttctgcagcaagtgttgggttgtaacggaagttgaaccagtatccggactcaacagctaacttctcctcggtctgagccttgctcatacccttcttgataccatggttgatacatggagcgtaagcaatgatcagtgatggtcccggataagcctctgcctctgcaagagccttaacacactgattcatatcagcacccatagagatgtgtgctacatatacataaccatagctcattgcgataccggcaagatccttcttctttgtctctttaccaccggcagcgaactgtgcgatcgcacctgtaggagtagacttagaagactgtccacctgtatttgagtaaacctcagtatcgaataccattacgttgatatccttaccggatgctaatacatggtctacaccaccgaatccgatgtcgtatgcccatccatcaccaccgaagatccactgagacttcttagcgaggaaatctttctcttttaatatattcttggaagcatcgcatccgcaagcctctaatgctgctactaacttctctgtagctggtccgttctcgataccggaagcgaatgtatcattccactccttgatggcatccttaacatcagccttatctgtgttagctgcgatctcatccagctcgttctttaatctgtcacggattgctctctgagcaagtaacataccataaccaaactctgctgcatcttcgaacagtgagttagaccatgcaggaccatgacccttcttgtttgttgtataaggtgtagaaggtgaagagtttgcccagatagaagaacatccagttgcatttgcaatgtacattctgtcaccgaataactgggtaattaacttagcgtaaggtgtctcaccacatccaccacaagctccggagaactcaagtaatggctgacggaactgagatcccttaacagagttaagtttgaatttctcgataacatcttccttatcctcaagagatactgcgtaatcgaagtacttctgctcatcctcatgtgcctcgaatccggtcattgtgatagcctgtaccttatcaggacatacatttacacaagaaccacatcctgtacagtcgaatgcggaaacaacgattgcgaacttgtaacctggcatctggttgagatccttcatctgcattccttccggagccttagctgcctcagcctctgtcatagcgactggacggattgctgcatgaggacatacataagaacactggttacactcgatacacttggtagcatcccatacaggaacgtctgttgcaacaccacgcttctcgtatgctgctgtaccggatggagtccagcctgtctcgtatttcttaacaacagatacaggaattgtgttaccctgctgtccgttgactttctgctgaatatccttaacgaagtcaacaacttccttgttgtctcccttaacttctacagagtaatcatcatctgtgcagttcttccagctctctggaacatctaccttaacgtatgctgtagcaccggcatcgattgcgtcgtggttcatcttaacgacatcgtcacccttcttagcataagatcttgtagctgcgtccttcataagcttgataacttcctcttccggaatcagctttgtcagagagaagaatgctgactgaagtacagtgttgatacggtttccaagaccgatctctttaccgatctttacaccgtcgatgatgtagaagttgatgttgttctctgcgatgtatctctttacctgacctggtaacttctcatccagttcatcaactgtccactgtgtattgaacaggaatgtaccgcccggtaccagatcctgaaccatgttgtacttgtagatgtatgctgtacagtgacatgctacgaagtttgcctgagagatcaggtatgtggaacggattggagaatgtccaaaacgtaagtgggaaattgtaacaccaccggacttcttggagtcataatcaaagtatgcctgagcgtacatatctgtgttgtcaccaatgatcttgatggagttcttgttggcacctactgtaccatctgcaccaagaccccagaacttacagtttgttgttccttctggtgtagtaacaggattctccttaacttcaagagaaagatttgtaacatcatcagtaataccgattgtaaatcttggcttctctgtgttgttgtatacagcgatgatctgtccaggagtagtatccttagatcctaatccgtaacgtccgcttgtaattgtaacctgatcgaacttagatccctttaatgcagcaactacatctaagtataatggctcaccaagagaacctggctcttttgttctgtctaatactgcaattctcttaacagtatccggaatagcctcgattaaagcttcctttacgaatggtctgtaaagacgaaccttaacaacaccgaccttctcgccctttgccattaagtaatcgatggtctcatcgatggtctcacatacagaacccatagcaatgatgacacggtcagcatcagcagctccgtagtagttgaacagcttgtagtctgtgccgatcttggcatttaccttgtccatatattcctgtacgattgcaggcagctcgtcgtatgtagagttgcaagcttctcttgactggaagaagatgtcagggttctgtgcagatcccatttctaccggatgatttggatttaatgcattcttacggaaagcatcaactgcatccatatctaccatatctttcagatcttcataatcccatgtctcgatcttctgaatttcgtgagatgtacggaatccatcgaagaagttgatgaatggaattcttcccttgattgctgcgcaatgagcaaccggagttaagtccataacttcctgtacggatgactcacaaagcattgcaacacctgtctgacggcaagcatatacatcagagtgatcaccgaagatgttcagtgcatgtgtagcaacacaacgagcggatacgttgaatacgcccggaagtctctcaccagctactttgtacaggttcgggatcataagtaacagaccctgggatgctgtgtaagtagttgttaatgcaccagctgcaagagatccgtgtacagtaccggctgcaccagcctcagactgcatttctgtaacctgaacggtctgtccgaaaatgttcttacgaccagcggttgcccactcatctgtagcctcagccataacagatgaaggagtaataggatagattgctgcaacatcagtaaacgcataagaagcgtgtgctgctgcatggtttccatccatggttttcattgaacgtttcatgaattagtcctcctatttttaattaaagttcaaacataaaaaacattgaatcagaatgtcttctaactaaataatataggatgaatgcacccaaaaatcaagcgatagcgacagcatttcttgtttttttacaaatacatcttttcaaagtcgccaatcggaaccggacaattgcataaatatccctgtccgcaggtgaatccaccttctttgaggaactgctcctgttcctccgtttccaccccctctataataatatctttatgtaaaatctttaccatacggccgatttcgtaaagaagatttttcttttgttccgtcatgcctttattaataaaacttttgtcaatttttatgacgtctgcaggcatatctgcaagtacggaaagtgaagaatatcctgttccgaaatcatcaattgccacacggaatccaatctcgtgcagccggttcatacacttttcaaggactgctacattttttacaagtacgccctctgtcacctcaatttctatatactccggacggacactgtatttggaaagcacatgctggatacggtttaaaaattcctctccgtccgactcaaaatgacgcccggaaaaattggttgaaatcacaatttttctccggtgctgcttgtcccatttttcgagagtttttaacacttcctcataaatataaaaatcaagctctgtgatatatcctattttttcgagagaatcaataaacattcccggcggaagaatctttccatccggacgtttccatcgtgccagtgcttctgccccgtaaacactccggtcacgtaaaataaactttggctgcagatacatctggaaatcatcccggtataatgcctcataaaattccccgactattttttgctcctcggtacgctggatacgcagggaaggattatacagggtaatatccctcttcccggtattttttgcatttttccatgcaagattggcattttcgatcgcaaactcgatgtccattttattgtcttccagaatatatacccctgccgatatccccattccactgtttggatacctgtgattctgcatattggaaaatcttttatttctgttgtgcagacgatcgatcattttttcctgactttcatctgcaatcagaagcagaaaaaaatccgaatacaaacggcagcctgcacggaaatactcctgcataaagatatcctgtgcaaacattttaaggacactgtcccctactttatagccataattttcattgatatatccaaaattattgatatccatatactcaatggcatatacttcatccggcttggaatgtgccagaatttcaaccaccgcttcacggaatgcctcctgattgtacagccctgtcagcggatcttttttctggatggaactgatctgttcccggctttccgcgacccgatagcgcagggacacaaaaatagccatcatacgggtcagttcctgaaaaatttccaactctcccggctgccactgccgttcttcgtccagtgacacataaattacttcccctgtacagcccccaacatattcaaattttccaaccacagcagaaaacggagctttttcgttgtatgtatccgttgacttaagatactttcccatccccgttgcaaaattgctccgcgaatttttaactatcatatactcccctggctgtagttcctttagtgaaggacttttctttggaaacgcacttttcccataaaaagagaaattatttccaaaataattggtcatgaccattccgtcattttcggtgttatcctcaaataccataacaagatccagctggtatctttccgtaatcctgtttaaaagcatattcagcgacccgtctatatttttggcgtgcgccataagactgatggaaaatgcaaggaattcacggtcttctgcgcccatgttttcccgccgctcaatgtttttgattccgtttctgatcattcccacatcttttgcaccggcaatctcatatccatttttgcccccctgcttggtacgatacatggcatgatccgctttttcaaacagggaactgtatgtatttccatccccaccgttacaggcggccagaccaatacttgccgagatcctgtagtgaatggagccccccgtataaactttgcagagtgcttctccaagatttccggcacgttcctttgccttctcgagtgttgtgttcttcatcagcacaaggaattcatccccaccgacccttccggtcagatcattgttgcggaaaaaagatttgataatatttgcaacatctacgattacggtatcaccgaatgtatgcccgaaattatcattgacacctttaaaattatcaatatcaatcagaaacaatacatgggttccgtcttctgctccttccagaaatgcatcggtctccctttggatttccagcttgttgagcagttttgtcagcggatctctccgcacttcttcctgaagattcttatcttcatcaatattaaaacttcttccgataatccgggtgatccgtccattatggtctgcaatgctcttgtaataagttctaaaccagagatatttcggtgtctcattttccgtatggatattaaaccttgtatccatacttccggttttttcctctgtggcagcttctttcatagccttcagaaaaagctcctgatccggtggacagagtgtcagaacttcttcatccaccggaaaatattgttcggaataatcgtattgtcccctcagttccatcagccggtacgagcgcagcatcgtccagttttccacatccagatcaaacggatattccaaagacagctgttccatcagctcatatttctggttcaacagtttctgatgttcttcccgtcttttttcctcatcaatatcccataaaaataaaaccacatatggttttacatcgtaatgtgccagaacactgcaccgcatctccacccaccgggttttcccatcggggcgtacgatacgaagctgcatttttccgttgtcatgtgtccggacaacattttccaatacactgaccagatttgcataatcttcgtcatataccattttttgtggtctggtttcccgcagttccttttccgtgtatccaagtacatccgtaaactctgcgtttgcctcttccactctccagtctgccccacaactgacaattgcaactgcgacaggcagatccaactgtataaattccctataatccatagctttgccccaatttcgttcaattctttctccattatatcattatttctatacatttccaacaagaaagcgtttttcttcttgaaatatatcccatgtcatgtttataatagaatttgtgattttatcatagacatattaagtaaagcaatgaggttttcgtatgattagtgcaaataacattactttaagattaggcaaaaaagcccttttcgaagatgtaaacgtaaagtttaccgaggggaactgttacggtttgatcggtgcaaacggtgccggcaaatctacctttttaaaaattttatccgggcagttagagccaaccagcggtgacattgtcatcacaccgggacagcgtctgtctttcctgcagcaggaccacttcaagtatgatgagtataccgtactcgacacggttatcatgggaaataaacgtctgtatgacatcatgaaagaaaaagatgccatctacatgaaagaagatttttccgatgaggatggtatccgcgccagtgaacttgaagcagaatttgcagacatggacggctggaatgccgaatccgatgctgccaccctgttaaacggtcttggaattccgaccgaggatcactacacacagatggcagacctgccgggtgccgcaaaagtcaaagtacttcttgcgcaggcactgtttggcaacccggacattcttcttctcgatgagccgaccaaccacctggatcttgatgccatcgcatggttagaagaatttctgatcaactttgaaaacacggttatcgtggtttcccatgaccgttatttcttaaacaaagtctgcaccaacattgcagacatggattacggcaaaatccagctgtatgccggaaactacgatttctggtatgaatccagccagcttcttgtccgtcagatgaaagaagccaacaagaaaaaggaagaaaaaatcaaagagctgcaggagtttatctcccgtttctctgcaaatgcttccaaatccaagcaggcaacttcccgtaagcgtgccctggaaaaaatccagctagatgacatccgtccttccagccgtaaatatccgtacattgatttccgtccaaaccgtgaaatcggaaatgaagttctgaccgtagacggaatcagtaaaaccattgacggtgtaaaagttctcgacaacatttcctttattgtcggacacgatgacaaaatcgcctttgtcggtggaaatgagcttgcaaagacaacattgtttaaaattctcgccggggaaatggaaccggatgaaggatcttacaaatggggagttacaacaagccagtcttatttcccgaaggataataccgccatctttgattccgatgagctgatcgttgactggctgacccaatactccgagatcaaagacgcaacttatgtccgcggtttcctcggccgtatgctttttgccggtgaagatggtgtaaaaaagatgcgtgtcctctccggtggagaaaaagtccgtgtccttctctcccgcatgatgatcatgggaagcaacgttttgatctttgatgagccgacagaccacctggatatggaatccatcaccgcattgaataatggtatgatcaaattccctggtgtcatcctgtttgcctgccgtgaccatcaggtcgtacagacaactgcgaaccgcatcatcgagtttcttccggatggaagcatggtagacaaggtttctacttatgacgaatatctcgaaagtgatgttatggcaagaaaacgtcaggtatacaatacaactgcagatgaggaggcagatgattaatctgttaccctctgtctgtttggtaaaaacaggaaaccctctctgctggtctgtccagcaaagagggtttcctgcatttcgaaaactcattttcaactattttaaaacatatctgtaaaaatatttccgctgttataattgtaattatacgtgccgttcttcgtatatgtattggattttgcggcttctgactttgcataggactctgtcatggctgcctttgttgccacactgtatgcataggaaccggttccattgaacaggctctttactttttctgtgtctgcacccttaaacgttgtctcatccaccgacagcctgccggtcttttcatcgaccgtaattcctatttcctttaagggtttctcattgtaagaagtctcatttttcatagaacttaccgaccgggaaatgcggttcgtcgatgacttgccggctgtatccagcatggagttgtaatcatccgcaaaactctttactgctttgtagatcttgtccgtatcgtagctgcccccggaatcctttgtaaacaccttgttgttactgcgggtatacaatgccttggcagagtctgtcagttccttggcatcggactctatcgcagccagcgtcttggtactgtcttttgacgttgatgtggtcgtggccagatcctcgatcgtatttttggtgctgtcatccgacttcgaggtgcccttcgtggaatccattgaaaaataagagcgcattaatttgccataagaaccactgcgaatacttgcatactcacttaaattgattccaaacaggccacttcctgtgcttttcgaagaacccagactggaaaataaagtacttactgacgatgaatcatacatcgaaattcctctcatagtatcacctctttcacacaattctttcttttatcctatcgctttttcactgtttttacaatacttttgtggtatttttccgtattttggttataattacgaaaagataacaatttcttttcgttttgttcatattttattcacaatcagatgctattataagaacataaaagaaagcaaagttactaacttgttattttttcataattcgccccattgtccattggacaatggggcactcctctttttatcaagaaatttcttaaatgtcttctatctgccagtcaatcggctcgattccatgttcttttagaaactgatttgcctgactgaaatgtctgcatccaaagaacccgcgatacgcggaaagcggacttggatgcggtgcctttaagatcaggtgctttggatttgtaagcatcggtattttgctctgcgccggacgtccccacaacatatacacaatcggacgatcctgcgcattcactgcctgaatgatcgcatccgtaaactgctcccatcctcttccctgatgggaatttgcctgatgcgcccgcaccgtaagcacggtattcaaaagcagtacaccctgatctgcccattttttcagatagccgttgtttggaattttacaccccagatcatcctgcagttctttataaatattctgcagagatggcggaatttctttctgatccggaaggacagaaaacgaaagaccatgtgcctgatgttcattgtgatacgggtcctgtcccagaatcagtacttttacctcactaagcggtgtaaaatgcagtgcattaaaaatatcctctgccggcggatacacaaccgtgcggctatactcttctttcacaaactgatacagctgccggtaatatggtttggcgaattcctcacggactgccggaagccagtcgtttgttatcattgccataatttcattcactcctatctacgcacggagacaccgcggtctgccagatagtttttcagatccatgatctccagctccttataatgaaacagggacgctgccagtgctgcatctgcatgtccctctgtcagagcctcataaaaatgttcttttgtgcccgcaccaccggatgcaatcactggaatggaaacattgtctgcaatctgtctggtcagttcaatatcataccctgcctttgttccatcgcagtccatgctggtcagaagaatttctcccgcaccaagtctgttagctttcattgcccattctacagcgtcaagcccggtatcaatacgaccgccgtttttgtaaacattccagccacttccatcctctcttcgtctggcatcaatggcgactaccacacactggctgccaaacttgtccgctgcatttccaatcagctccggtgtattgattgcggaagaattaatggaaatcttgtcggcaccttcccgaagcagtaccttaaaatcctccaccgtacggataccaccgcctaccgtaaacgggataaacaccttctctgcaaccttacgcaccatgtctaccaccgttgcacggtgatcggaagatgcggtaatatccagaaagactacttcatctgcgcccgccttgtcgtaagctgctgcgacctctaccggatctccggcatctcttaaattcacaaagttaatgccttttaccacgcgtccgtcattcacatccagacaaggaataattctcttcgtaaacactatgcatttcctccctgcagctttgcaaaatttttcaaaatcgaaagtccaaccgtaccgctcttttccggatggaactgacatgcaaatgtatttccggattctaccgatgcatgaattgtcgtactgtactgtgtggttgctttcactatctgttcatccgctgctttcagataataggaatgtacaaaatatacatacggattttcctccagcccagcaaaaagtcttccgtcattctgtaaatgcagagaattccacccgatgtgcggaatcttaagtcccgactgatccggaatccgcagaatctgtccgtccagcacatggagtccctctacaccctgactctcatcgcttccctcaaagagaagctgcagtcccagacagatgccaagaaatggcttattttccgctgtcacctgatgaatcaccttgtccagctcgtattttttcaattgttccatcgcatcgccaaatgcaccgactcccggaagaatcactttgtctgcggtctcaatctcgtgaaaattacgtgtgatcacacagtcttctccgagaaaatgcaatgctttttccacgctttttaaatttccagcgttgtagtctattattgcaatcatataggtcttactcctaaattaacagtctcctgccttactttctgctatttttttatcccagcccaagttctttcagcttctgatgcaattttaccgtataatcatcccgctttctggtctggtagatatccagtgcctcatcccctgtcatatcataatctttcagcagtgctttgataatctttcctccgatcttctccagctgatcttcacagccatactctttggcatttttctggttcaggtcataacgcccatatgcacataccagtgcatcaagtgcatcaatttttgaaccgtaattatcaaatacgagatatgcctgatacttttccgagacagcagcaagagttgccagctgatgataaagcttttcatcgcgctccttgatcgaaagcccctgcagcttacggtatgcctccacataagaaccctgctcatatttttcctttgcctgacttaagtttgcctgataccccaaaagatttgtcacaatcatgacaaatgcaaacaatgacactgccataagaacaatcgcaatcaccggtccctttggcagcggcggtgtgttatccacttccttaggttttttctcctttttcggtttcggcggttttggctgtttgggcttcttttctttcttcggttttttctcttttttcggtttttcctttttcttttccggttcccttccggcatcaccgcctgtaccttcaagttcctttaagatctgctggttttcctccgaaagttcactgacatccgctccctgtgtatttccgatgtcaaccgcctgcttttcttcctcatcatcctctccgaaaataatccgggaaagtttctgccagaagccgccttctttctcttttttctctttcttattctttttcttttttttatttttcccattggaagcggtttcttctgcctgtgccggtatgtcttcctgctctgtaagttctggaatcttatctgccacttcttcctgcggattcatttccgatcttgcaaaatcaccgatgaaatcagtttcttccaaaggttttccatcttgatcagaagaaagcatatcccccagatccgataaatcctgatctccggaaagcatatccataagatccgaatccgaaagccctgacagatccagttctccatcctcttcttttggcagattgctgtcaaacgttccgactgcatcatcaagtgtattcacctcgaaatcatcctcatcgggtggtattgcagtttccaacggacttttcccctgaaaaccggtttcttcttcctttgctgcatcccctgtcgaaaaatcatcctgtggaatattatcgagcagatcatccagggaagcgtcaatctgtgtggctttttcttcctgttttttttgattcaggctctcggtatactccggaatatcttccttgagcagttcttcctcaaactccctcaaaaaatcttcttcatttttcgcttttgccttttccttcgtttcttcttctccaaacaattgcttttcaaaatcatctctcagaacctgttttgctgcctgctgttccttcggatgttccgtttcttctccatgcatggaatttaataattgatccagataattttccgatgagtggtctcccatgtgtttttctccattccatctgtttattccataaacctgcaaagggatgtgatgaagccatcacaccccttactgttttgccggaatttatttgtttctctttgcaagtaattcatcaatggcatctacaagacttccgatttcaggtttggtcagctgtgcatctgcaccaagcgactccccttttcttctcatttcctcatttacaagagaggagaaaatgataaccggaagatgtttcagtttgtcatctgatttgatcagcttcgtaagacgatgtccgtccatctggggcatttcaatatcggtaatgacacaatgaacgttctcgtccaatgtccccgccttttcaaattcctgaatcttgtcccatgcttcctgtccattacatgtaacaatcagtttttcgtatcctgcttttttcaggcagtccgtaatcagactgctcagcaacggagaatcctctgcaatcagaattgtatcctcgctccggcttctctccccgatctgttcaatatcattgaccctgagaccggtttccggactgatggatgatacaattgcctcaaagtcaagaataacaaccagttttccgtccatcttgatcacaccagttgcaacacttccgtcttctccattaatcgtagaatccggtttgatgatctcattccatgatacacggtgaattcctaccacctgatccacatgaaatgccacatcaagtttattaaaattcgtgataataaacagaccttcctgtccatcatcctccatgccaagacactttttcagattgatgaccgtaatcatcacctcgcgcggcataaaaatgccttctacgctcggatgtgtattcggtacaggagtaaccttctggtatgacaaaatctccctgatctttgccacgttgattccgtaatgattatctcctaatgtaaactctaaaatttctaattcgttcgtccctgactctaacagaatatttgtatccatatacgtcctcccgcacttttctgtattggtaatcccttatgtttattatatcatattttgtaaaatttgggggcatttatttgtatttcagagaataaattgtatcttttatttctgcatacagtgtctcacccgaaattttatcagcctggtctttcggaatctgaaacagtaaaaccgctgttttcttctttccgcccctgatggtttccccataagaggaaagacttctggttccgagcgaagcagtctcctttatcctgttttttccgtcaaaacatgcataaaatgtaataccgagtttttctgtatccagcctgacctttttctttcccttatttttaatttcaaacttcatcacaacaagtttgtttccatcctcaggagttactgcaaaatagtctccctcctgatagatattctgaatcctgcatcctttgtaagaaacggtcagacccgatgcatgtccgattgcctcggcgatcggcatcgtctccatctcctgtgtctgggtttctcccgtggcatctgacgccatgttgttgtccgcactctgggtattctggctctccggcatctggctgtcctgtttttgtgtttcctgtgtctcttcggatgaagcggctgtcattccgtctttctgctcaatattatactttgcaagaatatgcgccgaatactgcacgaccagattttcttcgtcctctgacaaatcatacatctgggttccacagcctcccaacaggagtattgctgacactgccatcacaggcagacttattttctttttcatactcttttaccctcttgtcacttttgccctataatctatgttttatggtatcatattctgaaaaataagacaatcttttctttgcattaattattggtctccaattccatccaaaactccacaccgtccgggtgattgactgcaccgcatttctgatgaaaagaatccatgattgccttgacaatggacaatccgattccgcttccaccatattcacgtgttcttgctttgtctactttatagaatttcacccagatcttgtcaagatcctcttcgggaatcgggtcaccggtattaaacacactcgtgcgtaccagatggtcatgtttttgaaaacgaatggtaatctttttttctcctgccgcatggttcatggcattggtcaggaaattcgtaatcacctcttccaccttaaactcatccccccagacatataccggaccttccctgtaaaattcgatattcacctgtttttgtgccgccatgatggatgcagactggatcacgccgtcaatcagctccgtgatatcaaaccgtgtcatttccacggtatcattgccaaactccagctgattgagtgtcagcagctgctttaccatatgattcatcttttccgattcatccataatcacatcacagtaaaaatcacggctctctgcatcatcattgatgcattcttttaatccttccgcatatccctgtatgagtgccaacggtgttttcagctcgtgtgaaacattcgaaagaaattcttttctcatttcatcgatctgttcttttttctcgatatcctgctgcaggctgacgtttgctgtctttagttccgaaatcgtctcttccagtgtctccgacaattcattcatggaatttccaagttcatcaatctcccggctcacatgacgtaccggtatatactttgcatcaaaatccagctgtgtcatccttcttgcaatatcggataaggcatggatcggatgggaaattcctttcgagagaacgatgatcagaatcacacttaagatgatggctcccgtgctcaccattacaaaaaactggtttgttatgctcgcactttcccgaatgctttccacagccgcacgcatgtaaagattgtttccattttttaaagttcccagaagaaccagatactccgactgcagccgttcatcggtctgccgaagcagcgtataatcctttccggatgaaagcacctgcacacggctgcggtcacttccatacagccagtcctccatctgcatctgaaaacgctgtgcactgctgtaggaactccatatcaggtttctgtcctgatctgcaataagcatattgatatttccgtttgcacagattttctcgaactgcacatacgcatcatcactggaatccccctgcttttcacaaatcagccttacctggtcaaaactgctttttaactctttttccttatgaaaaatataatatttttccaaaaaggtggtattaaaaaaccagcacatcgcaaccgttcccgcaacaatgacaaccatcgtcaaaatcagctgccacgtcagggaagtcttttgtttcttttccatttaggacacctcaaacttgtaacccattccccatacggtttttatataacttccacatgccccgagtttatttctcagtttttttacatgtgtatcaatcgtccgtgcatccccaaaatagtcataattccacacactgtttaaaatgcgttccctcgagagggcaatcccctgattattcataaaatattccagcagttcaaactccttgaaactgagttccaccggatttcccgaaattttcacctcgtgcgccgtcttatccagaataatctctcctgccgtcttaagatcggccgcatcgccgatcttattggtccggcgcagaatcgcttcgacacgcgccacaagaattttcggtgaaaacggtttggttatatattcatcaaccccaaggtcaaatcccataagttcatcactctcatcacttttggccgtgagcatgatgatcgggactttggatgtctgacggatttccctgcagacttcccagccgttcatctttggcatcatcacatccagaatcagcaaagcgatcgctttgtctttataaaaaatatccagtgcttcctctccatctgctgcttctaagacttcatagttctgccgggtcaaaaaatcccgtaccagcttcctcatccggctctcatcatctaccacaaggatcttcactttgtccatctctattctgcctcctgttccgtcagtctcaattccctctcctcaagctggctttcccgttcatccagctgtttttcccagatttcgtatttatcaatcaccttattttcatagtttaaaatcgtcacattatcttcgctgagccacgtaatcacaagcatcccaatgatgccaagtgcaaaaacaactgcgaaaaatgtactgatgtgaaacagtttctgataatcccggttcttcttccggcggtttttactgaccacatgctctttgtttttctgtctttttttcttctgctttatttcctctttgcttcttttttcttttgaaaccattccttctggttcatacaccgtgatcggaagaatatcttctctccggatatagggaatggtatacagatattcctgaagcctgtgcaaaaaatcatatccgaccggcgtgacaaaaatttcttttaacaccagtttgttatataacgccagcacaatatccggatcatccattctcgtatttttccggatatacccgatgatctctacctcatgttttgctgtatgttcctgttcctttgtttcaaatgcgtagccttctacctgatacataacttatcctctaccatttataagcactgctggcatcccgttcggcgatttcgccgtcctgatatgcctgaatcagttttttcagttcctcaatgcggatcatcatgcgcttaccaacgtctgtatcacccaccagaatacgtttatcccggtattccactgcttcctgatgcgatacaatatccagttcatctcttaccgcctcgtttgaccagtcaaacggttcatgggcagaaagcgtcagtccataagaattgtacgtcagtgtatatcctgcaattcccgtttttctccggtatgtttttgaaaatccaccgtcgatcaggatcagttttccgttacacttgaccggattttcgccggcaatgcgctctaccggtacatgaccattgatgatatgcacaaaatcccccgtcagcccgaattctttaagtatattatctgccgtttcctctttgtcaaacaaatgataatacgcattcttactctcatgatgcatggacttgtccgcaagaaaataccgctcaaacgttgccatcttactccgtccgtacaaaggagaatccggtgccgtccagatataccacatgatatcccttcctttttccctctctttttcatccagagagaaaaatgccttgcggacataggattccagcacatcatagagtgcttttccgctgtattccctgccatatacatttactttcttaaatgtcccatccggattcagcggcacacatccatgataaagcagatttccgttgtagactttatacatgctgcctcgttttagcagaagccgtacatggcgctgcagtttctcacagtgtataaacgaggtgcgcagccggttcatgacttcctgttcctcaggtgtcagatcatacggatgttccggatcaatggtaggaaaactggtatccagcatgtcataggtttttccatcaatttccactgttttgttctcgtaattaatacggtgcagcagacagcggttttccataccatactccggccatttgtggatcagctgtccttccagtttaaactttatgatggcaattgccttatgcattttccggttcatcagcgtttctttcttgcttcgttcctcatccgtggaatctttcagtacaaactgtctgcacggatcatcgcggtaagcatccatggcaaatgttgcaagcggaaccatattgatgccataaccatcctcaatcagatccagattcccataccggatacttgtccggatcacagatgcaatgcaggcaagctgcccggctgctgcccccatccataccatatcgtgattcccccactggatatcaaacgaatgatattgttccagctgatccataatccggtccggtgacggaccgcggtcatacacatccccgagaatatgcagatgatcaatgaccagcctctgcaccagttccgccagtgccacaataaaattatctgcctgcccaagttccagaatggtgttgataattgcctcgtaataggcctctttattcaaaacctcctgcttttccgtaatcagttcctcgattacatacgcataatcctccggcagcgccttgcgcactttggatctggtgtatttggaagatactgtcttacacacctcgatcagccggtacagtgtgatcttataccagttctcgatatcgtcctcggtctgacgcactagctcgatttttttctgtggataataaatcagtgttgccagagacatcttatctgccgtacttagcgtatgcccgaatacgtcatcaatctttttgcggacggctccagacccgtttctcaatacgtgggaaaatgctttaaattccccatgtatatccgacaaaaaatgttccgtgccttttggcagatataaaatagactgcagattgataatttccgtagatgcttttccaatcgtcggatacagttctgcaagctgttcataataatgtaatcgttgtttttccacttataataccccttttcatgagcatacatccgctcattattcctatgaaacagtttaccataatttcctgcttttgtgcactcgttcacataaaaaacaaaaaaagaactgtatgccggacgcatcagttcccttttatgtatttatcctatacctttcgtctttcccctttctttttgttttgactgaatttgactttttatttacatattgattatatctttcctattttttcaattcggggctaaattttttgatatttccggcgacttttgtcggtcaggggtcagaaatgatccttatccggaaacgcgatatgtcatttgacctttttagcgtttattattataatagatttgatattttattcggaggtgatggttcatgctgacacgcgaacaattatccagaaatcttggaacaaatctggaaagagagcgctttaaactcggctattcacagcaggatatggcaaaagcactagatatgtccctttcctcgtacaaaagacttgccaatggggataccggaaaagtcgatgtctataccgtatataagctcagccagcttaccggaaagatgttctatgaattatgtggcgaatcctctgatttattccagacctatgaccgcatgcgcaatctttcgcctacacagttacattttattgaatcccttgtacagtttgaattcgattttgccagaaatctggaaacggttccatcggtttcccgcgaggactataccactatgatcattccaagtggaaacatgcacgatggaatggtgtatgattcctgttctctcgaaaaaatcaatatttccggataccgcaaacgctatggaaaccagattgattgtgcacttcttgtcacaagtgatcatatgtctcctgtctatcatgcaaacgatattttattaatcgcgcggaatcccatacgtgatggcgacaccggtatttttattaacaaagtgaccggtcttctttacatccgccgccttcgccagacagatccctggcgcttagaacctctcacctattacggacagacgttttatatcgacagtaataacgcatcggagatgtcccactggattatctttggtcatgttatttccaaaacccgtggataattcttattcatgcacaacaaaagacgccatcagatacttctgatgacgcctaatgatttccacactccattggactgctcctcacttcatcttttgttctatatccattcttcttttgtttaccgaaatgacgttctggacaaatcaccttttatccgttcctctttgtccgctctcttttgtactctgtcactggtttccattctcgaatgtttattctttcatcaagtgaagcctgatgacctgtgtttggttgctccctgccaatggcttatgttccctttggactgtacctccttacattagatttcacgtccagagctttctcgtcacccttcgtgatggctgcttgtttttttgttgtcttaaatataacacgcattttacattatgtcaacctgtttttttatttctttttatttttcctttatatttctcataattgtttattttattatgttttttcagataatttatttttttaaaaaagaacgtgctttcgcacgctctctttttgtatttatgccggcatagccagataatatccctgaaacagatccactcccaaagaccgtaaaaaatcacactcttctcttgtctccacaccttccgcaagcacctgcattcctctttcatggaaactttccagatatgtacggacgttctcctgttttctggcatcgttgtcaattccacagatcagggagcgatccagttttacgatatccggtgtatacagatatacagcattcatattgttttcacccatgccaaaatcatccagcgataccttccagtgcttattctggaccatctcactttttctgacccactcgcgtagggaaactttcggatactctaaaatctcaatgatcctttttcctttctggtttccaaaataagtatcaaatgcttctgcctcattctccgtaaaactttccgacgggaaagaattgatacagagatattcctgatatccccgctcaatatacgcctgtgttgcaccaaaaaaagtggcaacttccagtatatgcagtttctcatccctggcaaattcatcaatcagctgccccaccgtcatcttcttcggtctcatcaacgcttcatatgcatatattctcacacaatctttataaaagatcggctggaacacatattcaatctcaagtctttctaaagctgccttcacttcattgtccagcggtaatttttcatatgctatcataaatctgctccaaattttttacttctgttttttacctattaatttttaaaagaatggatcggagccggaatacgtcctgtacggttgataaagtcatcacaggagtatttgtttaccggcataaccggggcatatccaaacaatcctccaaattccactctgtctcccacaccttttcccacagccggaatcagacgtgcagcggttgtcttctggttcaccattccgattgccatctcgtctgcaatcattccggaaatggttgttgcctttgtatctcccgggatggcgatcatatccagacctaccgaacatacacaggtcattgcctctaatttttcaagggaaattgcgcctgcctctaccgcgttgatcatcccctgatcctcgctgaccggaataaaagcaccacttaaaccacccacataagaagaagccatcacgccgcccttctttacctgatcattgagcatggcaagtgctgcagtggttcccggtgcacctgcatactccagaccgcactcacagagaatatccgcaacactgtctccaattgccggagtcggtgccagggaaagatccacgataccaaacggaatgtttaacatcttagatgcctcctgtgccaccagctggccgacacgagtaaccttaaatgccgtctttttgatcgtctcacagagaacctcaaaattctctccgcgtactttttccagtgcattttttacaacacccggtccactgactccgacattgatgatcgcatctgcctcggtcactccgtggaaagctcctgccataaacggattatcgtccggtgcattgcaaaagaccaccagcttcatgcagtcggcagaatcgttgtcctttgaaatttctgccgtctgaagaataatctcgcccataagccgtactgcatccatgttgatgcccgtcttggtggatgccaggtttacggaactgcatacacgttcagtactgtgcagtgcctgtggaatggaacggatcagaagttcatccgctttcgtcatgcctttagataccagtgcggaatatccgccgatcagattgacgccgaccgtctttgctgcacgatccatagttgcggcgattgtagcaaaatcctccggtgtcttacaagccgaaccgcccaccagcgcaattggtgtcacagaaattctcttatttacgattggaatggaataacttttttcaatcttttctccggtcgctaccagatcttttgccacggttgtaatcttgttgtaaatattctgattcagacgatccagatccgaatcaatacagtcaagaagactgatcccgagtgtgatggttctcacatccagattctccttctcgatcatttcgttggtttcctgtacttcccagctgttaatcattctttgcttcctccatgttttagatacgatgcattttttcaaaaatttcttcgcgctgacatttgattgaaacgcctattttttctcccaatgcatccatttctccggaaatctctgcaaagtgcttctttgcatctgccatatccacaatcatcatcatattaaaaaatccagaaacaatcgtctgtgaaatatcaagcacgtttacgccgttgtcagcaagataagtacatacctttgcaataataccgacggtatcttttcctactactgtaataattgctttgtccattgttttttccataatataaactctcctttttactctgcacgaattacaggcgaaaccgcatttctttttgccacatacatcgggaaatcatccgctttgtacggattatcccccatcgtaacttccagacgcaccgcttcatacgccagttcctcgtaattattttccttgcttaaatggcccagtaccactgtgccgaatttatcatgaagaagttcacagagcagctggccactccgctcattcgacagatgtcccctgtttcccataatcctgcgtttcagcggataagggtatacgcccgtttcgagcatatgaatatcatgatttgcctccagcagcaaagtatcaagtccctgcagttgctgcacaatctcatcatcataatttcccagatcggttactaccgcaaaggtacggttttctttttttatccggtatgccacaggatccgccgcatcatgtgagatatggatcggggtaatcgtcaggtctccgattacaaaatcttcctgcggaacaatttcatgaaataattccgggtcgatctttcccacagacggcgtgttcttaatggcttcaatggttcctgctgttgcatacatcggcagcccatatcttcttgccataacaccaagtcccgcgatatgatccagatgttcatgtgtaaccagaatcccatccatatcctgactctttaaatccacctcgtttaatccattctcaatccgctttccgctgatccccgcatcaattaacacatggtggttgtccgagcctacacagatacagtttccactgctgccacttgcaatactgcataattctaacatactatttctctttccagtaaatttctacccggtctccattattaagcggctgggaaaattcagcttccgtgccatttacaagcgttgcaattgcacgtccgtttccggcgttgagatcaaacgtgatccggtcaaaaacatccacaaatatgtaatcttcttttcccgtaagttccaccgtctcgccatttaccgtgacaacacagaccgtatcttttttctccgactcagccgccttggtctccccggaggtttccggagtcatttcttcctgcgatatttccgcggaatctgtaaccccctctgttgcattataccgattctcactctctgacgcaaccccgaagcttaacggtgtccagtcaatggagaaattttcgtataccagggtctccatccccgcttccctgttattgaccagaatttcactgtccgggtcaatttccacgtccataaattctgcaatctgtgcaacggtataaaaattccgtgtctcgatggaatctccctcctgaatttcataggaatccggttcaaggcttccgtttacctcgacaaatttcggacataccacgttctgtccattgatcacaaacgaaatcacggactcgtgatactccggaagctgtccgatggtatacaccgcattatctcctgccgttgatggctcaatcgtaatatcggaatttggctccagcggtgtgttgatatttgccggttggccattcatcgtcactatggcggcctccccagcctctcctcttgcgattcttgcgcctccattcacggtgaaattgatcggcattccgcgtttcggaaacagctggtcattcggaaatcccgcctgcattgccgcatccacaatggtaagtctgttattatcatacagtttcaggcgttctccgttgaagcggaccataataaaattatttttctgttcataataattcaggcagattccaatcggtgtgacaagcagcggatcttttttgatatcttcctgctcaaatgtcacttctttaagcacttcttcgcctcttaatgccacacgctccgtcggcagatccagatgcccggcaagtttttccgtaaatccgtgaatctttccgccaccaccgacaacaaagcaggcgcttacggttttatccccattcagttccttgatctttgcagccacctcggaagtaatcttctccaccgtcggggcaaccagctcccagatctccttggatggaattgtatgggaaatactcataatatcctcatatgtcacttcatcctcactcgaagatgccagtttcattttctctgcagtctgaaaatcaaccagatactgctgcacgatcagctcggtcagttcatcccctgcatatggaatcataccataagctatgatacttccctctcttgtgatggaaatatccgatgttcccgctccgacatcgaccagtgcaatatttaacatccggaaattttcagggattgccacattgatcgccgcaattggctctaatgtcatattggcaaccgtcattttagcctgaccgactgcggaatacagcccgtccacaacatcttccggcaaaaatgttacgataatgtcctcaccgattttatttgctttatgtccttcaatactgataaatacttcttcgtttaaataatatttcacaaccgaatatccgacacagtaaaacttatattttgtgtcattctgttcccgcaaaatatcctgtgcctgctctacccccagaagatttaatgtgtggatatcttctcctgtgacgaccgactcctccgcatactcatactccacatgcgtagtgacggtttttaacacacggccggcggctgcaatacacacttccgaaagcggtgcatccagctgcgcctccagctctgcttttacagcggaaatcgtatgcgccacttttccaatatcatgaatctgtccatccagcatggaccgtgtctcatgctgtctgacatactgtgcctctacaataaaggctccatcttctgtccggtgtccaaccgttcccaccacattgcgggttcctatatccaaaccaaatacgttattcatatgcttctctcctcagcgcttcctctgtctgtgtcagtgtttcttccaatgtcccgttattatctattaccacccggcagtgtctgcggtattcctcctcactcagctggctggcaaaaatccggtccacatgtgcatcggaataccctcttgatgccttcagacgagctctccggttttcttctgtagtataaatataccagagttcatcacagatttcatcataatgttcctcgatcagaagtgcagcttccaaaaccagcagaaaaagttttccagcccgttcctctgcctctttctgttgcagaacatattcccggaccgccggatgtacaatggcattcagttcttctcttttccggtcatcggaaaagatgacagttgcaagctgcgcacggtccaacgatccgtccggctgataaatgtcttccccggcaaatttttcttttaacttttgaaaacattccgtccccggctgcatcagatcatgtgcaatctcatctgccagcataaccctgatacccggctttgacgcaagatgtgcaagtatggcagattttcctgctcccacccctcctgtaattccaataaaccgcattccatcacctcccgggtttgttccttttcgtatatttttcttaatgagcctcataccagtcctgtccgcatgccgtaccgacggcaagttccactttcagatcggctgctttttgcatttcttcttccaaaagtgcaatgaccttttccttttcttcctccgcagtctcaatcaacagttcatcatgtacctgcaaaatcagacgcgaacggaaatgttcccggatcagacggtcatgtacccggatcatggcaattttgataatatccgccgccgttccctgaatcggggcattcatggcgacacgctcgccaaactgtcttgtcataaaattacccgatgacagctccggaatcggacggatgcgtccaaacaaagttcttgtatatcccttttcctttgcctgtgctacggtgttgtccagaaattctttgatcttcggatatgtttcaaaatagctgtcgataaatccctgcgcttctttggttcctatatttaaatcctgactcagtccataggcactgatgccgtatacaattccaaagtttacagccttggcatttcttctctgtaagtctgtcacttcatcaaacgctacatgaaatactttggatgccgtacttcgatgaatgtcctgattttcgcggaacgcctcaatcagctgctcatcaccggacatatgtgccaaaagccgcaattcaatctgtgaataatcggaatcgacaaacaaatctcccggcattggatgaaatacttttcttatcatctttccaagttcaatccggatcgggatattctgcagattcggatctgtactgctcaatcgcccggttgccgtgatcgtctgatggaacgttgtatggatttttccggttgcatcaataaagtttgacagaccatctgcataggtagatttgagtttggaaagtttccggtattccagaatatctgcaacaatcggataatctccggcaagtttttccaagacttctgcagaagtcgaaaaaccggtctttgtcttttttccattcggaagctgcatcttttcgaaaagaatcacgccgagctgtttcggagaatttatgttaaacgtctcccccgcttcctcataaattttctgttccagttccccgatggaaaccgacagtttctgaccatactcttttaatgcattggcatcgatacagattccatcctgttccatatccgataagacaaacaccagaggcatctcgatttcgcgcatcagctgctccatcccatgttccttaagtccttccttaagaactgcggctgatttccatgtaatataagattcccagcaggcataccggagcacatccgcttccttttccgtgatgacatcccccggcgtctgtttgccaagcagatctgttctcgacggaatcatcagtcccagatagtcttttgcaatatcctcgtatggatacgctcccttgagtggattgagcaggtatgctgcaatcgtacggtcaaaaaaacgggttctcatttcttccggtacatcgtgcagatcaaaagcagccagcgccggctttaaatctgccgcatacagttcctgtcgttccagtagatcctgttttaatttttctgccggaagttcctgtgaagccaccataagataattgtcttcttccgaaaacgaaatggcaagcccggcaaatttctgttcctctgcggtatcaaacagggaaagctgctggttttgtactccctgctccaccacataaaagcctgccgcttttccctcggcttttttccagatccggtctgccgtcttctgatcctttacgatctgaaaactttcttccgcatggttttttggtgcgtccacggtaaaccggttcaaaagatttttaaattcgagtctcttacacagcaaataggcttcctctgtatacagagaagcctttccgtctatctttgcattggcaaaatcataatccaccggaacatctgtgatgatggttgcaagttctttgctcatcactgcctgatcccagtattctacaatatttttggatgcacgcggtggctttaccacatccgcatgtgcatgaacttcctcaatgcatccatactgtccgatcagcgcagtcgctgttttttctccaattcccggcacacccggaatattgtctgccgtatcccccatcagggcttttacgtcgataaattccttcggtgtcacctgataccgttctttgacatctgccgccagataatcttcaatctctgttccggtacgcttcgtctttggaatacgaatcctgacatgatccgtagcaagctgcagcagatcgcggtccccggatacgacagaaacttccatcccggcacgctctcccattccggcaagtgtaccgagaagatcatcggcttcgtatccttccatctcaatggtacagacccccatcgccgcaagcatttctttcatcagcggaacctgctgccgcagggcatcatccatcggttttcgtgttcccttatatgcctcatacattttatgacgaaaagttggtgcatgaacatcaaatgcaaccgtcagataatccggctgttcctcctctaatattttaaaaagaatattcaagaatccgtacacggcattggtatgcagaccttcggaatttgtcagatccggcagtccaaaaaatgcacggtttaatatgctgtgtccatcaatcagcaccagcttttcactcattacttctatttccttcccggccacggtttatattgcccgtgttgcctccttcagccatgccagctcctctccctgcagatacggggaaacaactttgtatacattggcatggtaatcattcagacgtttcttttcaacctccgtcatctgtttcggatcgatagcatccagatcaaacggaacataggtcagattttcaaaatacataaactgaccatattcatttttttcgcctttttggcatactaattcgttttccagacgtattccgtattttccttcgatataaattcccggttcatccgtagttaccattccttcttcaaaaacagctccccccggacgatcctcagttcctttatagcggaatgcattcggtccttcatgcacattgagcacatatcccacaccgtgtccggtcccgtgtttaaagtcaagtccggcttcccagaacggttcacgcgcgataatatcaaggttcatcccgctgcatccatacaggaaacgggcatttgccagattcatattggatctgcatacacgggtaaaatccgctttcatctcttctgtcaccggtccgagtgcaaatgttctcgtaatatctgtcgtaccttccagataatgtcctccggaatccaccagaagaagtccctccggtttcagtggaacatcactttccggtgttgctgcgtaatgtacgattgctccatgatccgcatacccgcagatcgtatcaaagctcaaatccagcaggccttcctgttctctgcggagactctccagataatccgatgcggaaatttccgtcattggaattttccccacatttttcttcagccagtacatgaatctgcacattgccactgcatcttttacatgggcttttctcgtattggaaatctctgtctcatttttgacagctttcatctccagcgtcggatcttctgcatctatcatctgtgcagactccggcagattattacagatttttgtattaaccacagcgcgattaagcagaatcgtctgattctccagtgtttttacatactcataaaatgcctcatacggacgcgtggtaattccattcttctgcagatattcccgcagggtatcatcgacaacttcttcctgcaggaaccagatgcactgttcctgtgtcaatgccaggtaggaaagaacaaccggcacataactgatgtcatttccacgtacattcaaaagccacgcaatatcatacaaagaagccagcaaatgcacctctgcacctttttccttcattttttcacggactgcggcaagcttatcttttgtacttcttccactgtatgcttcatccagaatccacacaggttctttggacatcggcggacgatctttccagatctgtccgatcagatcctcctgtacataaagttttccgtgtttcttttctgcgatctgctgcagttttgcgccccatcttccattgacaacccttccgtcaaatccgatggtcccgccctctttcagcgtctgttccacatattcatcaaccgtaggaacatgttcctctcccatacggtacagtgtcacagttgttccttctaactgttttgccgcctgcacaaaatatcttccgtctgtccacagtccggccttagtccgtgtaatcactgctgttccggccgaaccggtaaatccggtaataaatcttcttgctttaaaatattctccaacatactccgattcatgaaaatcagcggttggcacaatataaactgcaatgtcccttttttccatctcctgtctgagcgcagcaagtctttccggtatcattgcatgtcctccttcatctcaaaaaatttcgtatcaagttccggataagaacgtttcagggaaatcggttttccggaacggttcaaaaagcagtggctgcttctcgccgtcgtccgcagttctccggtttccttgtccgtcatcacatactcgacttccatcttaattccgttatatttcaccagcttcgtctgaatcacaacggtatcatcaaaatgtaccatactgtgatactctaccgcaatggataaaaccggactgataatttccatttcttccatctgtttatagctcagccccatctgatccatcagatccattctcgcttcttccatccatttcacataattgctgtgatgaatgatgcccatctgatccgtttcgtaatattttgcatgatgttcatatgggcgtaattttataccggtctgctgtccggcaacctgtatctcgtttctcatatcagacacctcctgtacagaaacttaacatctatattatgccacaagcagaccagaaattcaatgaagtttcatggtttcccggtggtgttccggcactgcatgaaccgtaacgtttactgttccccatacacctcttcataatcgctctcatctgcaaataaaacatactttccgtccagatatcccatatatccgttttctaccacatatcccttcatattttgtcttcttcctttcttttatttcccgttctttttggttgaagaccttgaatgaaaaactaaaacccaactgaaaatacgtctaataatcaaaattctgttctgaggtcaaataaagccctaataatggatgttcaaattcaaatatcatgctataattaaggcattccagatagcaggtatatatttgtttgcatgattaacagacggctggctacttgttatgcaaaagtaaatgcgacccgtctatttaatacctattgacaaatcgattactatctgcagcttcggtctaattactttttaacgaataaatctggcattaaatgcacttcatctggcgggatgaggtgcatttttaataatgacattaatgctttgaaatcttcatcatcctcttctacgagctcgtatggacttttatttccaagtccaggacgttttacactattgatatgattcattaataaagtcatatcttcttgcgtgtatgggtttaagctttttccttttggcacggcataacgaataaattcatgattcttctcgatacaccctttttgccatgaagccattggatcacagtaataaaggcttgttctataaactaggaagccatcctcatccagcgtaagttctaactcatctaccttcttgaattcgctgccgttgtcagttaatataaccggaaacaaccgtctaaaaacatctattcccaatcctgtctcgagatagtccagaaccctttttacggattctgcttttccatctggcatcaggaatagtagcattacgttgttctttctaaagatcattgtaagcaaacgctttccagattctctaacgccttttacagtatccatttctgttacttcatcttctgaatatttgaatttcatcgcatactcaaaatcctcatatgtcctacactgtctatactccattgagtgaaatccattgatatcgttgtactttttcttccgtggtttgtagcctgtctttcttcttaaatctatgtttttaatagataaggcaccttcatcgatatagttataaagtgttctcaaacacactggcatttcattttcatgttctgcatatatgtgtgttaaaggctggcctttcttaacaagtcgagtcacaagttcatccaattcttccttcttttcatcagaaagtctaactccttgtcgactctccgatctacgacgagttacagctgcatcagcgaatttcgcactgtaaatatacttatctttgttgcaaagctttttatccttacagttattacaaacatacggaggcgaatcaaacttatggcaagcaactgatacatatctatcgcataccttggtacaatccactcctctgcaaagtctacactttgtattacaggcttcttcatcacagccgcacaaattccttactgtgcattgtcttgccatgcggcaatcttttccattcgggtaattgcctttaatgaaggttctgttttctttaacttcatgtgcaatagtagatggatgtctgcgaagtctttttgctatttttttgaatgactccccgatgcatatcccagtttctattgctattcgatctgacaggtccatttgtccgctagcattgtaataattcatatctgctcctttcccagcagatagtaatcgatataaccaatatatcatgccttggaaagggctgtagaaaaagtaaactagaccttttatagccattttcagttgtcaaagtacaggtttaatttttcattttaggttttggttgaagacagtatctcatattcagtgtccgataaatggtacacaaaatcccccggaaatttccgggggatgaaaaactacttatttttcttttctttttttgtcggtggaatactgtatttgcgtgcatacgaatcaaagcactccagataagcatcgtctttcatgtgacggacgctctttaaatactcatgggtatcaaattccgaagtctccgtctcaatcattgctaccgcaacattggaacagtgcgctgcgattctttccagattcgtcagcagatcattaaacgcaaatccctgccggaattcacattttccttcccgcagtctggttacatgccggtttttgagatcattgcacaaaattccgatcagttcccgcaaaggctcgatttttgcagccatctccagatcatcctcgcagaaagcatcaactgtcagatcgacaatctccctgactgctgcctccagcacggaaagttccttctgtgccgactcggaaaatgtaatcttcttttccgaaatttcatttgcaactttagaaatattgaccgcatgatcccccagacgttcaaaatcgctgatcgtgtgcaggaatttggacacctgctgcatctggacggtagacatctcctgtcctgtcagctgcataagatatgtgccgagcttgtcctcatatttgtcaatcaggttttctttttcctgtactttattgtacttatcctgtgaataatctcctaacagtgaaagtgcacggttaatgttcttgcgtgccttctttgccatgccgttgaccgccgtatggctctgtccgatggcaagtgccggatacgccagaaatcgttcttcgaggagatcgaaatctgcctgctcttccagatcctccggatcgtctttgatcagacggaataccagtttctcaatcagattaatgcacggaagcagaatcatgattgttgccagacggaaaatagagttcatcatggcgatcttgatcgggctcatcgtcatattcaaaaacttaaagtgtacaaaagcattgacactgtaaaagacaatcgaccagaaaatcataccgaacagatcgttcagcagataaatcagggctgtacgttttccgtttttatttgtaccgatggaagaaagcagtaccgggcaggccgctcctactccaattcccatcgtaatcggaagtgctgccgcaaaactgatacttccggtcacggacaatgcctgcagaataccaacggatgcggaagcactctgtaaaactgcagtaaacgcaattcccacaataattcccataaacggattttcaaactttgtgagaagattgacgaaatgcgggttatctttcaatggggaaactgccccgctcatcgtctgcattcctaccatgaggattgcaaaaccaagcatgatatctcccacatttttgtagtttgcctttttgacaaacatcttaaaaataataccgataatcgcaacaacggcagaaatggttgccgtggacaacaactgtgcgataccgctggacccatcaatataggaaagacaaagaatccatccggtaacactcgtaccgatatttgctcccatgataattccaatcgcctgtgcgactttcatcattcccgaatttacgaatccgacaaccatgacggtcgttgcggaagatgactgaataatcgctgtaactatcgttccaagaagtacacctttgatcggtgtatttgtgagcttatacaatacaagctccagttggtttcctgccacacgtttgagtccgtctcccatcagagacattccataaagaaatagtgcaacaccactcagaagtgtcaggacaatcattatgccattcatatctgtttccttttcttgttcttcttttttacatgcttcgatttattataaaacacttctcatggtttttacaatcactttactcaaattttatgtttttatttttgaaacagactccggatcatatcaaacagcttttcaaaaaaggctgctatcttctgtccgatattcttgtccgcaagctgattctgcagctgggaagcccatgcagatgcctgatttttaatggaatcccagttcagatccagtccctgcagttttttcatcagaccaagaagtttctgcttgtcatcatccgataacttcagatcatatttatccgcaagtttttcaatcgcctgttccatctcctccggcgttttgatctttccactggcaatctgccctttcagatctgcaatcatcgcctccacatcattggaatcgccgtcaatgctctgctcaagatctccggttgtgacaagttcatccattgcagcatccacaaccgattcatccagttcctttccggtcagtttttcatatgcctcaaacgttccgaccagtgctgccgtcccggaaagcggaaacggtcccgcaacaatcacattggcatcttccacccctgcagtggcaagtgcgttcttgtacatgcccgccgtacagtagttaatgttgtatgtggataccttcagcccgttaccggaatctgccagggaaaccagcacggaagaaagcgctttcgttccgatctgttttttcggaacataagaatccagatactgatgttcttctgcattgctcacataaaccacatcatatttatcaaaatccgccgcttcgatccccatataagataacacggtatgctgctggtctgcagtcagatccgctccgagcgccagatatggcttgtcgtccagtgtaatttccacatcatccccgttatcttcctgtgcatcctctgcctctgtcgcatacaccggtgccggaactgctgcacttccaagaaccatgcctgccacaagaatccctgccatatattttttcaaacctttcatttttacctccattcataatccagaacaaatgtatttccctgcacatgtgcttttgccatggccccggtaacaaccggcatcataggagccatgtgtccgatgtccagatccatgatcaccggaacctgatactctgccagcagatcggttactgcccggtaatgatcaatcccgaatgcttcttctccgaaacacaccggccgtccgatcagaaatcccttcacatgcgaaaaccatccagcctctttcatctgccagatggcacggcggatggacatcacattcagatcacaggcttccagaaaccagagaaatccatcctctttataccgctcctgaaattcttttacgtgatcaaagcgcgtaccgagaaggtttaccagacaatccatacatccaccgatcagtcttccctccattgtaacattttcggctccctgtggaaatactttcagttccaccggctccgtcacatgatacggcgccagcggatgttcttcatctttgacagattctttctcccacagatcataattatgcacacgggtaatctttccgcagagcagatccagtgcgtcctgcacggccggatgccacggttccattccaaacgcggctgcgcacggtccgtaaatggcggccgtatctgcaatcgttgcagataagaacgtaaaattggtattatcggaaaaccccatataccactttggcttcgcctgcgcaatccctgcgaaatcaatatacggaacaacttcacacatcagctccccgccaccgcaggaaataatgacgtcattttcggttccgcaatagctttcattcagttctttgccacataatgccgggtcgttgctgatcccgattcccttatccaccagacaattcggccccatctgtgtatgatatcccatctgcccaaaccgttctcttgcatgtgcaaatgctgtataataaggttctgtcgcacagccgaatgacggcgcaacaaatccgatcgttccatgttcttttaaaaattccggaaatctcatattcactctcctcgtttcaggcttttcctgtttcctcattatataagaaaaaagaccgcagtgcaatccactgacggtctctcatacacagtaacaacaaatatttatcccgcatactgcgcaaactgataacggaatttctgtaaaaaatacagatagtaggatttcatattaaaccacagggaaaaatccttgcgataatgaaattttgtaacatataaaattccctgacgattgcaccatatataaatatcattcagcccaagccgcttgattccgcggatattgcgcagaaaggtctcaatttttgataactctccctcatcacgggcatacagatgaaaaatggtattcgggcattcgatcagaatatgtcctgccggcttttctgccatatcatatacctccctgattactcctcttatatgtatctatggtactacaatatctgtcaaaaaaccagtcaattttacacatttttccaattatttcacacgccttctgcatttgaaaaatccggaataaaactttcttttgccacccccggctcctgaatgaaagcctgggtaattccaagcgcaatcgcagcgtccacatagcggtcatatgtgcgccggctcacccggtgcgcaagttccggataatctctgacatgttctagcggcgtatactgactcatcagactcacatagattttgttctggtatgtttcatataaataccggacaatgtttctggcatctttcagacatccgggcaaaagcagctggcgcacaatcacacccctcttcatcacagctccctcgcaggcttcctctggcacgtcttcgcctcttttttcttcccacgcaaacaccggccggggctgctgacgcaccatctctgcaattgcagcctttgctgtctgcggataatctggtgcatgggaatattttgccgcaagaaacgggtccatatacttaaaatccggaagataaatatccacgattccttccagtgccttgatggtatccacattctcatagcttcccgtattgtatacaataggaaccgcaagtccctgccgtctcgcctgttctaccgcccggatgatatgcggcacatactgccccggtgtaaccagattgatattgttcgccccctgttcctgcagttccagaaaaatctccaccagccgttccggtgtgatttcttttcccgcagtcccctgtgcaatcggctcattctgacaaaacacacagtgcagggcacagccggaaaaaaagacggctcccgaaccttttgttccgctgatacacggttcttcccagaaatgcagagccgcccgtgctacctttaatgtctctgtcaccccacagattccagtttttcccttactgcgctgcgccccgcatgtgcgctgacacagcatgcaattgtcatagaaattatgatttttcatttgtttcacttgcgattcctttccaaaacctctacaatgaagtacacatacattatatcattttaaggagctacatatgaatcagtcaaactgtatggtcgcacagtcaggcggcccaaccgcagcaatcaacgccagtctcgccggagtcatctccggaataaaaaagtccggcaagtacgacacctgctacggggcaatcaatggaatcctcggtattttaaatgagcattatctgaatctttcccagatgatcccggatgaaaaaacccttaaccggttaaaagttacaccggccatgtatttaggttcctgccggcacaaacttccagactacaaagatgatgactctgcttatgtattcatcttcaaccagtttgcaaaattaaacatcaaagcctttttctatatcggtggcaatgactccatggatactgtacttaaattatccgattatgccgccaaaatcaagagcgacatccggattatcggagttccaaagaccattgacaacgatctatgcatgatcgaccacacacccggattcggttctgccgccaaatacattgcatccacaatgctggaaattgcacacgatacgtttatttacgcggtaaaaagcgtcactatcgtagaaattatggggcgcgatgccggatggctcactgctgccagcgccctggcacgaaatgactacaacactgccccacattttatttatctcccggaagttgcatttgacaaagagcagtttctgaccgatatccggaacaaattaaaaacattaaacaatgtgattgttgccgtatccgagggaatccgtgacaaaaacggagactacatcacagcttccaaatcagtggctgaccagttcggacaccagcagctctccggagccggaaaagcacttgaatttctggtcaaggaaaacatcggcgtcaaagtccgttccatagaaatcaatgtattgcagcgctgtgcctcccatctggcatctgctaccgatcagtcagaggcatttgcactcggagaacatgctgttttgctcgctgaggaaggtgtaaccgcctccatggtaaccctgacgcgcacctcgaataccccatatgcggtagcctatgaccatgccccgatccgcgacattgccaatgaggcaaaatccatcccgcgtgaatggatcaatgcacacggaaacgatatccgtcaggagctttacaactatctttatccgttaatccagggagaggtttctctcacctatcaaaacggtgtaccggtgtatatgccggttcctcatttaaaaccagatcacgtctcataaaaaggagagttttatggcaaaacgaacaacctctttgagggtactccgcggcattctctgcggtacaggtgcagctgtcatcggcatctatgcaggtttttgtgtttattaccacgggcattatttcccccatacaaccatcggtgggatttcctgtggcaaccagactgcgaatgatctggaagcaaaaaacattgcttccgcgcaaaattaccagctgcacataacggatcgcaaagggaacaaatacacactttccggaagtgacttttcctatacttacaaacgttccggtgaagaacaatcgcttgtaaaacagcagaaaatcctgttgtggccggttgccctgtttcaaaaacaccaaatagatctgaaccgttcttttcactacgatgaaaccgcattaaaccagctgaccgatgcgctggctatctttgatccttcctatatcgaagcaccggagaatgcacatctgcgtattatggatgatgattataccatcgtaaatgagacaccaggaaatacccccatccgcgatgagatcataaaggaaatccaaaaagccatagacgatcaggaaactacactcacgctttccgatgcctgctacgaaaaaccgtccgtaacggcagatgaccagcagattgcagatacggtttcacagcttgaccggtatatggccgcaaccgtcacctacgaaatcaaaggagctgacgaagggctggataaagccggtatcctgtctttacttgacctcaaaaaagacggctcggtttccatcaatgatacccggctgacttcctatgtccagcatctggcaagtacttacaacacctatggggatgtacggaaattcaagacaagcaaaggggacaccgtaaaaatcggcggtggcgattacggctgggtaattgacaaatccaaagaaaaaaaagagctcttaaaagacttaaaaggtggaaaacctgtaaaacgggaacctgtctatgagcagcgcgccatgcagagcggactggatgatatcggcaatacttatgtggaaattgactataccagccagcatctctggtattacaaggacggatcacttgtcacagacaccggcattgtttcgggaaacatcagccgcggaaacggctcaccggatggcatctttaagattgcatacaaacagaaagatgccacacttgtcggcgaaaattatgcgtccgatgtcagatatttcatgccgtttgcctacaatgtcggcatccacgatgcaagctggcgcagcacatttggcaaagagatctacaaaacttccggttctcacggctgtatcaatgtgcctccgaaaaaggcaaaaaaactgtttcagactctacaggtcggcactccggtaattgcctattaccgggaaccggttacgctgacggcagaaaacacacgcatctccaatgcatactcttataaagccgaaaccgggctttaaccctgatcaaactgactgttatacagcgttgcataaaagccgttctgtgccagcagggtatcatgatttccctgttcgataatctttccgtctttcatgaccagaatactgtctgcctcccggatcgtggaaagacgatgcgccacaatgaaacttgtacgtcccttcatcatcgtcagaaatgccttctgtatacggatttccgttcttgtatcaatagaggaagtagcctcgtcaagaatcagcatcggcggaaggcataacatgacacgggtaatacaaagaagctgcttttgtccctgtgacagattgcccccatcttctgtaatctcagtatcataccctttcgacagtctgcggataaagctgtgtgcatggcttgcttttgccgctgcaatcatttcttcctcggttgcatccggttttcccatacagatattctcccggatggttccctttttcagccacgtttcctgtaataccattccataatttttccgcaggctgtgtctggtcatgtgcatcacatcatgtccgctcacctggatatgcccggaatcagcatcataaaaacgcatcagaagattaatcagtgtcgtttttccacatccggttgggccgacaatggcaatcctctgtcccggctgtacatgcagattaaaatcctcgatcagcttctgctccggcacataggaaaaatacacatggtcaatgtctaccgttccgtctgcctgttctaactgatacgcatctgctgcatccggctcttcttcttttgcctcaatcagttcaaagaaacgcgccgcacatgccagggcattctgcagttctgtcacaacccccgaaatctcattaaacggcttggtatactgatttgcataagacaaaaaacaggaaagatttccgacagaaaatgctccgcctgtcagaataacggcaagtgctcccgtaattcccacagctgcatataccagactgttaacaaaacgtgtactcgggttcaccagactcgaaaaaaaggttgcccgcagcgaatatttctgcagacggtcatttacatccgcaaactgtccgagtgcttccttttcatggcaaaatgcctgtacgaccttctgatttccgaccatctcttcaatcagtgctgtctgttctcctctcgtctgcgtctgcagctgaaacatggaatacgtcttttttgcaataaagccagccacaaacaaagaaatcggtgtcagaagcacaaccacaacagtaatcttaacattgacaaagagcataaacagcaaggtaccgatgatcgttgccagaccggtaaacagctgtgtgaatcccatcagcaaaccatccgcaaacgtgtccacatccgcaatgatacggctgaccatgtccccatgggaatgactgtcaatataagacaacggcagatgctcgatcctctcaaacgcatcccttcggatatcacggacaatattgtatgtcatacggttattgcacatattcataatccactgtgccgcagccgtaatgccaattacaattgcgccttcttttgcaattgcaagaatccccggaaaatccacatttcctttgtccagaatcaggtcaatcgcccgtccggtcagaatcgggaaatacagtgtcagtgccactgtcaccgttgccagcacaacagacagaatcagtatgggaatatagtgtttcagataatgcatcactttttttagtgttgcaatctgtccggtcatgttcttctgcttagacatttcctgcacctccgttctttcccagatcttctttcttaaactgggattcataaatctcacgataaatttcacagttttcaagcagctcctcatgcgttcccagtcccactgcctgtccgtcatccatcaccagtatctggtctgcaaactggatggaggaagttctctgggaaacaataaatatggttttatttccctgcagattacgcagtgcggccctcagacgcgcatcggtggcaaaatccagtgccgatgcactgtcatcgagaatcagaatctccggatcttttacaacggcacgggcaatcgtcagacgctgcttttgtccgccggagaggtttcgtccgccctgttcaatcacataatccagaccgccctcttttccctttaccacatccgctgcctgcgccacttcaatggcatgccacaactgttcctctgtcgcatccggatttccccagcgcagattctgcgcaatcgttccctgaaacaatacggctttctgcatgacaacaccaatgcgctgtcgcagatccgcaagcggatactcacgcacatcggttcctgcaacctttatgcttccctgggatacatcgtaaaaacgcgggatcaggttgaccaccgaacttttaccggaaccggttccaccgataattccgattgtctgtccttttttcactttcagattaatatctgtaagagaatcctgcgcatttcccgcatatttcatagaaacatgggaaaattccacctccagttcactggatgcgcttttctttgtctctgtgacagaatccgtaatcgtcggtactacctcaagcacctcctgaatacggtttccacaggcaatcgccttattgatggtaatgatcagatttgcaagttttaccagctccaccagtatctgtgacatatagtttaccagtgcaatcacctcaccctgactgatccgtccgatgtcaacctgccggcctccgacccagatcaccgcaataattgcgaaattaataatcacataagtcagggggttcatcaatgtggaaattcttcctaccagcatctgaatctttgtcagataagcgttgctctcattaaaatccttcgtttcctcttcctgcttgttaaaggcacggatgacacgggcaccgtctaaattttcccgcgtgtgtccgagaacttcatcaagcccgcgctgtactttcttaaacagcggaatactgacaagcatcacggaaaaaacaacaaccgacaaaagtggaattgtaacgacgaaaatcagcgctgcctttacatccacggtaaatgccatgatcatggcaccaaatacaataaacggagaccttaaaaacagccggagtaccatattgacgcccgactgcgtctggttgatatcgctggtcatacgtgtgatcagcgtagaagtcccaatggtatccatttccgaaaaagacagtttctgaatatgggaaaacagtgcatagcggactttggtagaaaaccctaccgccgctttcgccgcaaagtactgtgccgtaatcgaacatgccagtccaatcagtgcaagcagcaccataacgcctcccatcttaaaaatataagacttgtttgatgccgcaattccatgatcgataatcgctgccacaacaagcggaacaatcagctcaaaagatgcttctaacagcttaaacagcggcgccagaatacattctttgcggtattcgttcagataaatcagtaattttctcataatcccttttcctttatatttatttgcctgaatcattataacactcacacccaggggattcaacagctttgcacgtcctctcccggaaccaggcaacgacaaaaagaccggcacaagccagtctctttgcaataaagtatgttgaacatttaattaatggcacccatgacagttcttgcagtcaccaccacaggttatggattttccattttttttgtctttgatgatgcttctaatcacaagagaaaccactactaacaagatgattaatacaattgcggtacccattactaccactccttccatcaaacaaagaggacgatccatacgttttttctgattcaatgttagtatatcctaactcccattagttgtcaacaacttttgttaatttttttgctagaccatttccacagattatgttataatcctacttaatgaaacaaaaggtaacatcgggaggaatcaatcatgcatagtacggaatcatccgagaattatttagagactattttaatattaagtaaaaaacttccggtggtgcgttccgttgacattgccaacgaacttggctttaaaaaatcaagtgtcagtatcgccatgaaaaatctccgtgaaaaaaatcagatcacggtcacagacgccggatttatatatctgacagacgaaggacgtgccatcgcagaaatgatctacgagcggcatgagctgctttccaaaggactggtcgcgctgggtgtcgatccgaaagtagctacagaagatgcatgccgtattgagcatgtgatcagtgccgaaagttttgcggctatcaagaaacatcttcatctgccaaaagacgcagaataatctttcctgccggaatataagaatacataaatagaaccggataccgctttttgtttatcgcaaattacggtatccggtttttattctttgttcgggtttgcagcatcgtcataggtatccagaaaatgatgtcttaccccatcttttttatatccaatcacggtatttaaatttacattctccacactgcggaaaatatttttagctacataaggattctcctgttcaagactatggatcagacgcttcacatctgctctctttgaccctttttctgttcctccacaggatgcacacccttcggtaaaacggcaggcacactgaatgaaatgcaggtcattgtactgtgcccagtggatgatatccgcttccctcacaagatacaatgggcggatcagttccattccctcaaaatttgtactgtgcagcttcggcatcatcgtctgaatctgcgcgccgtacaacattcccatcacaatggtctcgatgacatcgtcaaagtggtgtccaagcgcgatcttattgcatcctaattcccgtgctttactgtacagataccctctgcgcatccgtgcgcaaagatagcacggggaatccgtaatatccacaaccgtatcaaaaatttctgtccggaacaccgtaatcggaatattaagcatttttgcattatttaaaattgtctggtaattcacctcattatatcccggattcataaccagaaaaacaacttcaaaatttttctttccgtgccgttccagctcctgaaataactttgccatgagcatggaatcctttcctccggatatgcacactgcaatcttatctccatcctgtatcatttcatacgcattgattgcctttgtaaaaggtctccagaccgtctttttgaattttttaatgatactgcgctccgcatccgccgccttgtctgccagacgctctgcagtcccgtcatcctctttcataaagtctgccagttttttgcgcagataggaacggtatccgccctctatgctgtatatctcatatcctttgtccgataactcttccgcgatttcatcacttctctgtccggtataacagaacagatacaccggctgatccttcggtatctccccgatatgatccataaatgtttcccagaaaatatgcttcgcccccggataggtttcctttgtataatcttcctcacttcttatatcaatcaccagtttttctctctggtcattttgcagctcatctactgtttttcggtacatgccttttctccaattctgaattgttccataaaatccatccctcattatagcattgtaccctgccccgaacaagtctcaattacagcaacagcactttctataccgtttcttcatgttcccgtatcattttaaacagctgtacccggtttcgtatccccagtttccggtatatatttaaaatatgctttttgagggtattcgtactgatcgtaagttcttcacagatgaccggattttcttttccctgcatcagattgtagagtatggtattttccctcctggtcagaccgtatttttccaccgcctgtgtaaccgtaagtttttctccatcctctcccagcttttttttatgtttttccatccggtacgccagatgatctttgagcatatcgaggacaaaaatatcatcatatttaaaattttcttttcctatggtacggtaaaatgtgatcgtccccagaaaatgatgatcttttgcaatgacaacctgcagggaataatgccagttgttcggtttgtatactttcttataatattcggtctctacccgtgactcatcactgataatatcggtctccctgtaaatgagtgattttccactgagcataatccctctgctgtaatccagctcctcatataattccgagagattgctgtcacagttatacattaccggccgatccagtttcttttcatcttccgcggaagcaagataaaaatccgcgctgtcaaaatccaccagcagtttcagctgctccagcagttcccttcgcatttcatcaaaatcttccagcgtatagactttataaatgatggtatttaaaataatccaatcgtttgtttccaatgtcttcatttgtttttctccgatcatgaaaagacggcgcacctctatgaggtacgccgtctttggcttctattactatacagcagataacgggagtcgaacccgcctccccagcttgggaagctggtgttctaccgatgaactacatctgcattttcatagcatattgtagcacatcttctctgccttgtcaccaaaaaaatacttaatttggattattttactattatcactttaaacagctttaattattgtatccatgtcctgttgcatcttctacaatagaagaatttctcaaatcaaatttcttttttttcaatgctgattttttaataacaaacttcacatcttttgtagaataaccaagaacagtcacatttttccttgatgtcttatatacaccaactgtttttccattttcgtctttcacagtaatcttgacatttttcatgcatgccatccggccagaaccattatatgcaaccctcgctgtcatgacaagatttccagatttatcaaatgatgctttataaacgtttattccccattctttgtatcccagatcacttgatgcaataactttgtcagtatatttattttccttaacttctacctgacaaatcagattctgaccatcttcggtcactgcatatacggtagtttttccagccttgacaccagttaccttaccattcttatctacttttgcaatcttttcattcttagatttccatgattttaccttcgcaccggtaacagacagtttcttggtaaatcccttcgtaattatagctttggtattgctaatttttgcattttcattgagctgatcaatttctaaaatatactgagtatctgatgaaaatgtaattccacagctataatctccagaagaaaaacccttcaaagaataaataaaagcatacccttgaagtttctccacatacatccagtccgatgtaacaactgaaaccgggttctgattcatagcttccaactttccagtactatcataaatagaaatttgcatatttattgctgccggtgccagcactgtaatagcaagttctttattggatgcagccgtaaatggaaccttaatttcactacctgccgtagcattttctaatgccgaggatatatataacgtttgtacgttctctgcagcctccacagaagtacctcctgcaaatactgtggtaaacaccactgcaaacgccagcataaaagttacaatcctcttggttacatttgttttcataatttttccctttctatctgtatgttgttctacctttatagtatcacatatcaaagaggaaaccgcaagccgttctttcttcctattttaacagtctttgacaagatctttaaccacttccccggcaatgatcagtccgaccaccgacggcacaaaggccacacttcccggaattgcccggcgctccgtacacttgtgctttgctcccggcggacagatacagtttgagcggcagctaatcgccatatcttctaccggtttgatcggttcttccctggaatacacaacctttaatttctttacgccccgcttcttaagctctctgcgcatgaccttcgctaaaggacacacactggtcttgtaaatatctgccacttcaaatttgcttgcatctaacttatttccagcccccatactgctgataatcggaatgttcatctcttttgctttcatcaccagcgcaatttttgcagtgaccgtatctaccgcgtccacaatataatcatattcttcaaaaggaaagtcctttgcgttttccggcaggaaaaaacagtcatggatttccaccttcacatccggattgatttcgagcatgcgctctttcataacttctgttttatatttaccaaccgtctttcttgttgcgatgatctgacgattcagattcgtcagacataccttgtcatcatcgatcagatcaaaatatcctacgcctgtccggaccagtgcctcacagacgtatccgcccacaccaccgattccaaacactgccacacgggcatttttcagccggtccatcgcctcttttccgagcagtaattccgttctagaaaactgtgttaacatatatgaactccttttatcctattttccctatcgcaatacattatattatggcaggttccaaactgcaagcctctctttctactacaatatatttatggttaatatcccttacagccagtaaggaattatccatcttgttgcttaagctgtataatgatggggcaattggtatatcgtcttcccttcttggactttgcgtccgttaaatagactgataaccagctcctcattcgcagcgttcgttttatgcaggttgaatcgccataggtgcattcgcgtcacaccacagtagattgaataggcaatgagtaaaactggtatttatccattgcaataatcttaaggagtgacaatttatgaacgcagtaggtatcgatgtttcaaaaggtaagagtatggttgctatcatgcggcctttcggtgaaattgtttccgcacctttcgaaatcaaacacacagccagtgatatcaattcacttgtagaactcatcaactctgttgaaggtgagtcccgaatcgtgatggagcacacaggacgttactatgaagccctcgcccatcagctttcagaggcaaatcttttcgtcagtgccattaacccaaaacttatcaaagactttgataatgattctcttcgtaaagtgaaatctgataaagcggatgctattaagattgcccgatatgctcttgacaaatggcaaaatcttaaacagtataatgttatggatgaattacgcaatcagctcaaaaccatgaaccgtcagttcggtttttacatgaagcacaagacggctatgaaaaataatcttatcggcatccttgaccaaacctatcctggtgttaatacttactttgacagtcctgcacgcagtgacggcagccagaaatgggttgattttgcatctacatactggcatgtggactgtgtccgtaaaatgtctctgaatgcctttatcgtccattatcaaaactggtgcaaacgtaagaagtacaacttcagccaatccaaagctgaggaaatctatggaaaagcaaaggaacttgttcctgtacttcctaaggatgacattacaaagcttattatcaagcaggctgtaaaccagcttaacagtgcttctacaaccgttgaatcactacgcacacttatgaatgaaactgcatccaaactcccagagtatcctattgttatggcgatgaaaggggttggtgcttcgcttggtcctcaattgatggctgagattggtgatgtttcccgttttacccataaaggtgctattactgcttttgctggtgtagatcccggtgttaatgaatcgggaagttatgaacaaaaaagtgttccaacttcaaaacgaggctcatctgatcttagaaagaccttatttcaggtaatggatgttttaataaaaacacacccacaggatgatcctgtgtatcagttcttagacaagaagcgggcacaaggcaagccttactatgtctatatgactgcaggtgccaacaagtttctaagaatctattacggacgagtgaaagaatatctttcatctcttccagaatcctaatcatcattataattttcagaccagcactggtgtggtggtcttattttgatacctaattttcaacctgtataaaattttcaatgttctttaatttagccttgactttttatttgcaggctatttatataattatagaagaaaaggggctgtgaaaaaagaatagtcccgaaaaaagaaagaccaagagtttataatgaactcaaggtctttctttctgttataattaacttgcaatgaaaattaataacataatctattctaacccaaaacaggcagttttgccaatactaattcaagattatctggacatctgtgatccggtgctgacatttgacagatttatgggagaaatcgaactggagaaatatctgaaaaatattccgcaacatgatacaggaagactcagatatgacccggtcagcatgctgaagacagttttgtttggatttatggcaaatggctatatatcattacgtgagctggaggatcagtgtaaagtcaatctccgcttcatgtatctcatggatcatcaaacaccttcttaccgtaccttcggctactttataaacgaggtacttgctgattccatagaagaaatatttcaggacataaacaaaaaaatcttcgagacagaacacgtggatctccaacacctatacattgatggctccaagtttgaagcaaatgcgaataaatactcctgggtatggaaaaaatcaacagaaaaatccagataccgtctatttgataagatcaccacactctttgaggaaatcaataaggaactggaatgtacgggtataaagttttgtatcaatagcgagtatgcgccagagtatctgaaagaagctgctgaacagtatgcagaagtctggcagattgatgaaacgatgtttgttcatggcaggggacatcgcaaaactacgcagcaacgtcattatgagaaactcagggagtatactgccaagctggaagaatatgtagaaaaaatcaggatctgtggagaagatcgtaatagctactcaaaaacagatcattcagctacttttatgcgaatcaagacagactacatgggaaatgaccagctgcttccagcttataatgtacaggttggtgttgcagatgaatacattgctgttgttgatgtaaatcagtaccgttccgatatggactgttttattccactaatgaacaagtttcagaatatatatggtttctatccaaagtatccagtcgcagatgccggatatggttcttacaacaattacatcttctgtgagcagcatggaatggaaaaatatatgaagttccccatgttcaagaaagaaactactgacaagaagtatcatgaagatccatttcgtgcagtaaatttcccaatcggggaggacggaatcatgcgttgtccaaacgggaaaagcttttatcttcagtatcgtaaaaatgtaaagggaaacaagtatggacgacaggaagaagtatatcagtgtgaagattgttccggctgtccatatgcagaacaatgtaaaaagacagataaaaaccgtaccgttcggctcaaccatgaacttacatcgatgcatcaggaagtgattgaaaatctcgaaagtatcaagggagcgcttctaaggatgaacagatccattcaggccgaaggtacatttggtatcataaaaaacgaccgttggtataaaagaattgtccgaagagggataaaatctgtattgcttgaagtatttcttgtttctattggacacaatctttataaatatcacaataaacagaaaaaagtcgcaactgccgcataggattccataatagcattcttatggggaaagggggagtatacacttttttataaaatataactactgttgtatctataagcaaaaggacgcatgaaaaaactttcgttttttcacacgccctttctctttttcaactattcagaacccgccaattgaaatccgcgcatacacttaatggccccaatatcttccattgcgtttaccatgcggtaaacggttgcaacgccgatttttggatctacctttgatgccttgaaatagatttccttacagcaggaacaatcttcctcaaggataatatccagcagcatcagccgctgcttggtaatcctacagcctgattccttcagtttttgaataatcatttctctctgcatcatttggcatctcttctttttctattttgctgacacagttttctttgcgtcaaagtttaatgtgttactctccttataaggacggaacagcagataaataaatccgatgatcagtaagaatgctacaacggtaccaacaccgaatgtaccaactgtgatcagtgtaccgatctggtagatacacagggaaacaatgtaagctaagatacactgatatccgatcgcaaaccagaaccacttcacgttgttcatctcacgcttgatcgcacccatagctgcgaaacatggtgcacataacaggttgaataccaggaaaccataagcggcaaccggagtcataaccaaagacagtgacttccagatttcggaaccatcttctgcaacttctgcaaaaccgaataactgtccgaacgtagctacaacgttctcttttgcgatcagaccggatacagcagcaactgccatcttccagccgttaccagccttggtccagccaagtggtgcgaagatccatgcgattgcagaaccaacttttgcaagaacacattctgcctgggcagcctcaagagcagcaccctctaatccgtcgaaatcaagcattccaaaggttccgttgctccatccgaagttcattaagaaccataaaacaattgttgataacaggataattgtacctgctttcttgatgaaagaccatccacgctcccacatgctgcggagtacgtttccaacggttggccagtgatatgcaggaagctccataacgaatggtgcaggctctcctgcgaacatctttgttttctttaagataataccagaacagataattgctgcaacacctacaaagtaagcactccatgcaacccatccggaattatggaagaatgcacctgcgatcaaagcaataatcggaagctttgctccacaaggtacgaatgttgttgtcatgattgtcatcttgcggtcacggtcgttctcgatcgtacgggaagccataacaccaggaacaccgcatccactaccaatcagcattgggatgaatgattttccggataatccgaatttacggaaaatacggtccatgataaatgcgatacgtgacatatatccacaggactcaaggaatgctaggaaaatgaacagtaccagcatctgtggtacgaatccaagtacagcacccacaccggaaatgataccatctacgacaagtcctgtcagccagccggcacagtgaatgttctcaagtaaggttcttgctcccggaacaatccactcggcaaacaatgtatcatttgtccaatcggtaaggaatccaccaactgttgtgatagatacataatatacgataaacataaccaatgcaaaaatcggaagtgcaaaaaaacggttcgtaacaaaacggtcaatcttatccgaagtggaaagtttctcacccttctttgcttttgtaagacactctccaatgatggaagaaatgtatacataacgctcattggtaatgattgactcggtatcatcatcaaaatgatcctcaagttccttgatctctgcagatacatctggcatcagacttaagagttcagaaatcttatcgtctttttccagaagtttgattgcgaaaaaccgcttctgttcctgtggaatatccgagctgatcttatcctctacctttgcaatgatatcctcaacctctgatgagaacgcatgtgcaggtgtgactttcttcttctgctgtgcgagagcaacggccttttctgctgcctttgtaattccggttcctttcagagcggaaatctcaacaacttcgcagcccagtttctggctcagcttatcgatatgtatcacatcgccattcttggcaacgatatccatcatgtttactgccatgattaccggaataccaagttccatgatctgtgtagaaagatataagttacgctcaatatttgtaccgtccacaatattgatgattgcatccggtctgtctgcaacaagataatttcttgccaccacttcctccagggtgtatggggaaagagaataaatacccggaagatccatgatggtaacatctttatgacccttcagacgtccttcctttttttctactgttacacccggccagttaccaacaaactgattggaaccggtcaatgcattgaacaatgtcgtttttccgcagtttggatttcctgccaatgcaattttcactgccataattctcctcttttctgtgctggcgcacttttgttttatcagccttgctaaaatttgaaattgctagtttctgtaagcacttgctagtttttgtaagtcgctactaaccttatggtacaaaaattactctacctggatcatttcagcatctgctttacgcagggacagttcataccctctgaccgtaacttccaccggatctccgagtggggctactttacggacataaatctctacgcccttggtaattcccatgtccatgatacgacgttttacaggtccttcgcctgtcagttttgtagctttgacagtctcgccaacttttgcatcttttaatgtcttcatcgctgttccctttctaaatcattattttatttgccatatccttaccgatagcaacacgcgcttctttcacattcacaatcatgtttccatccgtttcagatatcacagccacttttcccccgacaacaaaaccaagattctcaagatggcgtcttgtttcttcttttccaccgatctttttaatctcattctcttctcctgctttgcacattgttaaaggcatcataaaaacatcctcctgctttccgccgcgtgcaagcgactttattgagaatcatttccatctcttacgtcagttagtatatgctaacggccataagttgtcaataacaaaataatattttttcagcttatccgacatttttttcttaaataatcaggtaccagcacacaaaatttctccgttattaagcgtttgcaagtgctttcccaagtgccttgcactgttccattgcatctgcatccggagcctcctgacagatgacaccttcccctcctacgatcgttgcaccggctccgctcatacgtgcttcccagtcacgcatccactgtccgtccccccatccgtaggaaccaaacagtccgatcttctttccggaagcaaatccttccacgtctgcaacaaacggctccatctcactctcttcgagtacttctgctcccatggcaggacatcctaatgcaaatacaccctctccctttaactcgtcaatgttcatatcactgacaaatacagcttccgcctctttgcctgcctctttgattccttccacgacggcatttgccatgctttctgtgtttccaccctgtgtccaaaatacaactgaaatcttactcattttaaattctccttttctttttataatgttatgatgcatattgacagtcacaatcaaccagctgccagatttccgtattgctgcaaatcgcaataatctcttcaatgcgcattccatatgacaaaagctggatcagtttttctctggaatgttcatatttctgaaacagccggattttttcatgcggtctgtcatatactttccagtaacccgaatacaaatagtttttcccctgattgtggatgaacccttttacatcctccggcggatatccaagcaaaagccccatctcatgcggaaaaactttcttttctttcaaatactgctgataatgtgtgcgaaacaccggcagcacctgttttaagtctgtgtcgatataaccgatctcatgtaacaacgcaagcacactttccccggaaaaaaatttttccaggcgctccctgtgatacaggaacacggtaatcttccccgcatgaattcccagcggataaatcgtcagttcactttctttaaaaatatctttcatccgctggtaatcctgttttttgatattcagcagattcgattctttcagtccggtgatcagcggtgcacactgaaatgctatctgaagttcgatctcatcgccacgcagtttacgcatgatctcccatatttctctgctcaagtccgtcgctccttcccaaagttagttatttctaactcatagaaagaatacacgaaaaaacaggctcccgtcaagagcctgcattgatattttttatcaattatattttattttgtgtataccgcaccagagcatcccggtaaatagcgcccagccggctcggaagaacctttttgtgcgtcacggtaccgatatgcatatccccctgtgcttccaacggaacggcaacaatattctctccgtttaattcctcgtcaatcaccccgctgcagactgtataaccattcagaccaatcagcagattaaacagggttgcccggtctctgacacggatgtttttcggccggtccacggtactgaatatctcctcggagaagtaaaaagaattgtgttctccctgttcaaaagaaagatacggatacggctccagttcttcgattgtcacagactttttgcccgcaagcggatttttcgtgctcacaaaaatatgcggttttgccacaaaaagctcggtaaacacaaggtcatgttccttgatcagtttctcaagtacggtacggttaaaatcgttcagataaagaattccgatctcgcttttcatctgcgcgacatcctctatgatttcatacgtctgggtttcccgcagacagaaatcatacttttcgcttccatactgctcgatcagttccacaaatgcattgactgcaaacgaataatgctgggtggaaacactaaattcctgtttccgcccagcttttttcttgtatgtttcctccagcagtgccgcctgttccagaacctgtctggcataccctaaaaaagtctccccctctttggatatgacaattccgcggtttgtccgttcaaaaatggtaatccccatctctttttccagttccctgactgcctttgtcagactcggctgggaaataaataatttctttgccgcatcactgatcgtcccggtctgtgcaacggtcgtaacatatttcaactgctgtaaggtcataaagcatcctcctataagatgtcaatatactctccgtttaatgctttattcatgctgcggacagcgcagaatttaccgcacatggaacaggtatcctcctgttccggtgcccggtccgcacgaatggctttggcggtctccgggtccatggcacatgcccactgtgcttcccaatccagtactcttctggcatccgccatcttattgtccatctccatggctcccggtacatgctttgcgatatctgccgcgtgcgctgcaatctttgatgccataattccctgctttacatcgtccacattcggaagtgccagatgctcagctggtgtcacatagcagaggaatgccgcaccgttggcagcagcgatcgcaccaccgatggcagaagtgatatgatcatatcccggcgcaatatcggtcaccagaggccccagtacataaaacggtgcacccatgcagatggtctgctggatcttcatatttgcagcaatctgatccatcggcatatgtcccggcccttccaccataacctggacatccttttcccaggcacgttttgtcagttctcccagacggacaagttcttcaatctgacagacatccgaagcatctgcaagacatcccggacgacaagcatctcccagtgagattgtcacatcatattcccggcagatgtcaagaatttcatcataatattcataaaacggattttcttccccggtcattgtcatccacgcaaatactaaagaaccgccacgggatacaatgttcatcttccgcttgtggtttttgatctgatcgatggtttttctggtaatgccacagtgcagggtaacaaaatccacaccatcctctgcatgcagacgtacaacatcaataaaatcttttgccgtgagtgttgccaggtctctctgatagtgtatcacagaatcgtataccggtacagttccaatcatcgccggacattccgaagtcagttttctccggaatcctgtagtatctccatgggaagacagatccatgattgcgtccgctcccatatccaccgctgccataactttctgcatttcaatatcataatctttccagtctctggatactccaagattgacattgattttggtccggagcatggagcccacaccctgcgggtccagacatttatggtttttatttgcgcagatggcaacctttccggctgccaccagaggcatcaactcttccacacgcaagtgttccttctgtgcaactttctttaattcttctgttacgattccttttcttgcagcttccatctgcgttttgtattctctcattggtttctcccttccttgcataaaataaaaaaacacacgtataatgcttatacgtgtgtggtaactttcattttccctacgttggcattatccaaatcaggttataggtcaaagcaatacagcttactctcagccttctttttgaaagctccctttttcttattttaaatataattcattattatacaatccatggatgctgtcaagattttccctgtaagttccgataaaaatacataaatttgccaggaagtagattgtcattttctgtgttttacgctatgatgaaattattaggcaaatttacaggaacctcttattacggagaatacatgttatgaaaaaacctgatttaaccaaatacaaaactacaagcacgctttatctgcttattcttatcattgcagctgttgcactggttttcggctggcagtgtacctcatacagtctcagcaaccacagcacggatctgcacatccagatgctcccgtcccggcgtgttaaggtatccaaagcaactactgtttaccggatttccgatgtccgatggaccaaaaaggcttctaccctgatgttttacagccagcatcagaccgtggttgtggaagtagacggaaagctgctttatacgcgtagcctcaaaacggacagtattctgcatacaaccggacgtaattgtgaaatggtctctgtcccggaaaatacacgtagcatcctcgtcacactcaccaactgcaacctggacaaacaggtgtctgatccggttttctatcagggcgatggtgtccatatgtttcgccatgaacttttaaaagcagggatccccatgctcctcggcattatgaacgttgtacttggcattctgatgctcatctactggctgtttgtgcatcattgggcatatgtgagcaaatccatgctgtatctgggaattcttacaacggatcttggtgcatggttctgcctggaaacaagctcttccattcttctgtcacagaacccggtgttccattcctatgtgacccgcatgcttcttctgctgctgcccattccttttatgatgttcgtccggcattatttaaaagcaagggaccggtatctttgccggatttttgtctggctggatgtggcagagattgcagttgttttattcctgcagcttatggatatccgtgacctgacgcagacactctggatgacccatgtcatgatcggccttgcagttttatattttatctataccatctgcaacaaattttatcaccacacgacgacacatgccctgtggatctgtaccatagggatcattattctgatcggtgctcttttttccgacatgtacaattattatcaggggtcgcaggacatcgaaattgtcggccgcatcgccatgctgctttttatcgtaacccttgcctgcgacaccgcattcgtatccctaaaggaaatcgataccggccgtcgcgcggctctctaccgtgaacttgcggaaaaggatctcctgaccggctgctacaaccggaatgcttaccacgaagataccagccggtgcaaaaaactgacaaatcttctgttgtttgtatttgacctgaacaacctgaaatactacaatgataaattcggacatgactgtggggatcagtatattacggatgccgcacatattctccggaaaattttctcccgtcacggaaaactgtaccgcatcggcggggatgaattctgtgttttgattgacgaccataatacctgtgatatcagccatctgatctgctgtctgcgaaaagaggaggccgtttacaacgcctcctcccgaaacatccatctgcagattgcctgtggatatgctgtctttgatccacggacagatacgaatctggatgcccttcaaaagcgggcagatcagaatatgtacgaaaacaaaaaacagttaaaaacattttcctaccgctgaggttctgcctgcagcggtatttttgcgacatcttttttacggagtttctttacctcatacaactgctcgtccgcaagcgaaagtgcatccgcaagactgtgctcatcgcccggctctaacgcacaggcaccgatggaaaccgttacgttatacggtttgtcactctgttcattccgaacggtgaatgcatcgtataactcctgtaataacagttcttttttcttttccgtcatcagtgcacatgcatactcatccccgccgattctcgcaacaaccccatcccctgtctgctccttttggacaatctctgcaagaatttccgcgatggtgtgcagggaataatccccttcctcatgtccgtaccggtcattgatgattttaagattgttcatatccgcataaagcaccagaaatgttttttccgctgctcttgcttttttcagcataggctccgcatattcgaaaaatcccctccggttacagatcccggtcagtggatctttctttgaaagtgtttccagttccagattgttttcctttaagacatacagagattcctctaactgtttctgaatattctcattgtttttcagaagattcagcatcttgactgctgccgaaatctgattacttaaaaattctccatattccagcacttcatcggtcagatcacacactaaaattccatacagcatttcattggcatacagaggaagcgttaccatccatgcccggtcagacattcccagcctggaaaaccggaaaatattttttgccttttttttctgatgaatggcgggtatattttctacatttccatgaagttcgctggctttcagcagcagctgctccggcatctgaaataattcatgattcagatgaatgaccggctcctcatagatgtacaaaaatgcattatgtatctttaaccattccattgttgcaagaatttccccaaaactctgatcggttcctttttcaaaacaaagcagtttcaaaataaagtttttcatttcgaaatttacccgtttctgctttccgaacagttcatcggcccagtgattcatggactcgtatttttccagcacatcattgcgcgcatccacttcttcctgatttccccggcaaaacgaattccggatcaccagatcggtcggaaggcgcacagaagagactttttctccctgcatcatccggcataacagttcacatgctttgctgccaagttttgacacatccgcacgtaccgaagaaagtgtcggataaatctgggaacaccactccgtatcatcatacccgaaaaccgagatatcccttcccggcataagcccccgcgccttcagttcttcataaaatccggctgcagtttcatcattgacacaaaaaacggcttccagatccggattgtcatccagaagtctggcataggcgctatgcgaatttcctgtcagatccccttccacataccgtttttcctgcggtaagataccgttcttccagagtgcactctcaaacgtagctttgcgctccattgcatcggaattttccttcggtccgcctaccattccgatttttgtgtaatgcagatcctgcacgagataatcgattccctgccggattccacggtcattgtcataactgacatttacatatccttccagatcagaggaaaccagaacgcatggaattccatcatagtgatgcataaattcaaccatacgttctttcgtcgtgtaacagccaatacagtttgccgctacgataatcccgtccagacggcctttttgtacactcgaaaacagggtatcatactgatattcatacataatatccgtgttctgcgcgtaatcacggtctaaaaattttcccggaagcactaccatgttgacatcctgctcttttgctgccgccctcagacctttacacaaaaaacgtgtaaaatcgtctgtgatgcctccgaccatcacgcctatggttttccttgtttttgtcatatctatccgccccttagctcatttcaattaaagttagctcattttctattcttaataagattattttaatataattttatgtttatatcaattatatttttagctaattttagtcggataaatttgtggaatgtgatctaaatctcttcacattctccggaatcctcgataatccgaagtccggctgtgctggtaaccggaagagaaaacgcaatggttcccgcttttgtcccgattccggctttttccatgatggatttcataatcgcatttttctgttccgttttcgtaacaattaatataatttctttttcggaaaccagcgatacgccgagaaactgttctgcccgtttcattccaacacctttcccgtgaaaaaccgttcccccggtggctccgccttcttctgccgcacgcatcacctgcgtattgtatccgtaattggcaattgcaatgatcagctcatgttttgtctccttcaacgttgtctcctcccctttctcgaattcctgttctcccagcataaatttcagctgatgttttccgccaatactgctaagcggtatcagaaagacaattcccgtcccgggcacatcaattttcaattccgtctgcaatccctttttcacggttttccaggtgggacgtgtgaccagacaaaaatgaatgcctttctcatcctcctcgagtccaaagtaatccagtacatcgctggccgctgttcccattgcaagagaaatatttccagtatccacgtgattttgcttataaaacttcgcaaatttctgcatctgttttcgattgcagatcgtaaccatcatatagatctcactcatttgtccgctcctctttcctgtttttctataattctataattgcatcatccgcatacccggcaaacacatcctctgcctgcagtaatggctgttctgccatttcttcctttttattactcttaatcttatagatcagcccgaggacctgcagcgtaatcagcggagtcatggcaaccatcgctaccacgccgaaggcatcctttaccacatcgccgcctactgccgtacaagcgccctgtgccagtggcaacagaaaagttgccgtcatcggaccggatgccacgcctccggagtcaaacgcaatcgcggtaaagattttcggaacaaataacgtcagaaacagtgcaatggcatagcccggaattaaaaaatacataatcggaattccggtaagcacccgcagcatggaaagtccgaccgaagcagccacaccgaccgaaagactgatctgcatcgcttttccggaaatctccccatcggtcagttcttctacctgtttcatcaggacatagacggccggctctgccttgacaatgaaatatccgatcaccattccgaccggaactaaaatccacggacacggcagtgatgccataacggttccaagatagtttcctgcgggaataaatccgacattggcaccggtcaagaaaagtaccagtccgacatacgtgtaaagcagtcccacacagattttaatcaatgtctttttatgtagttgaatggaaacaagctggaaaattccaaaaaagaaaacgattggaagcagggaacctgcaatttctttgagataatagggaatttcggataaaaacagccggccaagttccacagaattgaaagcttccggcacgtccgctgccacataacttccctgggcaggatataccagtcccaggagcaataccgcaagaacaggaccgatcgaacacagtgcaaccagtccgaaactgtcgttttccgcatgcttatcatttcggattgcagaaataccaacaccaagtgccataataaacggaaccgtcatcggtccggtcgtcacacctccggaatcaaacgccaccgccagaaaattatccggaacaaaccttgcgatcacaaatatcacaccatagaacacaactaataacggggctaacgctattccaaataaaatacgaagcagtgctacaacaagaaatgcgccaaccccggctgccaccgaaagaatcagcaccatattcggcaccgacggcacctgagcggcaagcacctgcagatccggttctgaaatggtaatgatgaccccgagaaaaaagcccagaaggaggatcacccatagttttttggttttaagcatgctgcctcctacacgttcccccataggagacattgacatttcggcacccatggaaaaaaacagcatgcctataattacaaacaccgcaccgatcataaattccagcagaatactggcggacaccggtgccactgtaaaactcagtaacaatacaatgaacagaatcggcaatactgcctgtatggattcttttgctttttcttttctcttttccaaacaatccctccttcttcctgtatattttcatacaatttatatatgtatgccatattatcatacactagaaggaaaaaccagcaaattttccctaagatttggttaaaatattattttttaaaaccggcatgcggaaaatctgtatcagcagaggaatgaccataataaaccatacgagtggttccgccacgattacacctgtgtagccaaaccacggaacgagtgttgctgcaatcacgattttgccgatcatttccagtgaacttgataccagcggtgtaatatggtctcccagcccctgcatggcattacggacgacacatatcactgccgtgacaaaataaaacagcgtatcaaacttcagataattggttgcattcttcagtacttcggcatttttgcttccagttaccatgtaaaccagccagtctccgattgtataacttgcaacaatggtaaagctgcaccagatacaggtatataaaattgcaagcccgattcccttttttatccggtcaatccgtcctgctccaagattctgtccgcagtatgttgccatcgtctgtccgaataccgtaaacataatcataaacatttccgatattttgcgggctgcggtatgtgcaacgataatgttctgtcccagtttattgattgccgtctgcagcgtcagggaaccgatattgatcagggaactcataaaccccatggacagacccgcgcttagcatgctttggatcatctgcggctgtggctctttgaaatcgtccctggacaaccggagcagttcataccgttttatcatatagatccagcagatcacaaacgccaacgcctgtgccgaaaccgtggcaaccgcggctccccttacccccgtttttaaaacgaccacaaaaaagagatcccccgcaatgttcaatatgacagagattgcaagaatcaccaaaggcgtaatggtatctccgagtgcacgcagtgcagcagcgcaggcatcataaagaaatgttgcaatcaatcccgcaataataattacaatataagaacccgccattgtccttaaattttccggtacatttaaaaagcgtaaaatcggctgcagaaaaagcagaccgagaaccgtcagtcccgcagcaacggcaattccgagtgtcagtgacatggcaaacgattttttcaccccgcgcagatcctttgctccgaaccgctgtgcagtaatgatggcaaacccgttggaaagccccatcagaaagccgatgatcagattgctcagtgaacttgtggcaccgacagccgcaagtgcatcttcccccagaaacgatccgacaatccgggtatccaccaggctgtatgtaagctgcagcagattggccagaaaaatcggaagcgcaaaagcgagtattaatcgggaaggttttccttttgtaagatctttcattttattacctcgtaaaaaaatttctcttttttcataaaataaacatattttttgtcgaaaataataatatcacaatttgtaaaggatagatactatgaaaacaacaggaatcgtttctggaaaaagcccagaaaatccggtcagggatttaacccctgttcccgctgcttccggaaataggtcatcatctccctagtgagacttaatccttccggatcatccggcacatcccggtaatctacccattcggcaagtgacagttcctcctcttcgagccggatctcaccttcttctgccagatcgcagaaaaatcccatcagaaggttactgtcaaagccccatggctggcttttataataacggatatttttcactttcagcccgacttcttccatcacctcccggtggacagtttcttccgcggtttccccgatttccgtaaaaccggcaatgagcgcataccgtttgtattccctacctgcatactttgtcatcatgatctgatcgttatttgtcagtccgatgatgactgccggcgcaatcttcggaaaaaccatattgttacagaccggacactgcaacatgcgctccgtgcggctgtgtacaagcggatgtgcgcatctgccgcagaattgattatcccggtaccacacatacagatgccatgccgttgttgcggcaaatacacgctccttcggtttcatggaccggaccgcaaacagtttatgatacataaatcccggaatttccacatcttcataaagctctgtcagataaaaagatatgtcatccacggaaaacagatataccagtccgggcacttttttgtgatgtgtcttacagtattccacccacacgtgatacttaagaaatgtgatctccccctcgtttttcagataaaccgtccgatcacgaaatgccagtatcctgctgtctgcatccggttctttcatttgaaatgcattgtctaatttcattggataaatgtcctgtatcatgattgcttctctcttttcctgtttatcattgttttgtccgcatctgactccggtaaggtcagatcaaccgcatcaattatcgcataaagcctcttaaatatcaaattttcttgacgaaaatccgggatacggctatactatatgtttatctatctacacacaacagggggattttatatgcagatacaattatctgaacatttcacttacaaaaaattattgcggttcgtccttccttccatcgtcatgatgatctttacttccatctacggtgtagtggacgggctctttgtttccaattatgtcggaaagactgcttttgccgctgtcaatctgatcatgccgtttctcatggcaatctccgctctaggcttcatgatcggtaccggaggcagtgcgatcgttgcaaagacattaggcgaaggcaaaaagaaacaggcaaacgaatatttttccatgctggtatacctcacgctgatcggaggcattgtcctctccgcgctcggcatcctcttttccccgctgattgcacgcgggcttggtgccgacggtgcgctgttgacaaactgtgtgctttatgcccgcattacgctgctctccatgccggcctttatgctccagaacgtattccagagtttctttgtcaccgcagaaaaaccaaaacttggtcttggtgtcatcgtcatcgcgggtgtcaccaatatggttctggactttttactggtaggcgttttccagatcggtctggccggtgcggcattcgcaacagtcaccagcgaatgtatcggtggtctgtttccgatcctttattttgcacgcaaaaattccagccttcttaagctcggacgcacacactttaacggaaaaatttttctgtgcgcctgcggaaacggttcgtccgaactaatgaccaacctttccagttccattgtcaactccctgtacaatattcagcttatgaatcttgccggagaaaacggtgtggctgcgtttggaacgatcatgtatgtaaactttatttttattgccatttttctgggatattccatcggaagtgcaccgcttgtcagctatcactacggagcgggcaaccatgacgaattaaaaaatctgttcggaaaaagtctgcggctcatcggaatctggggactcatgctgtttattctggcgcagctgatcgccagacctctggccgccatctttgtcggatatgatgcggatctgttttccatgacccaaaacggtttccgtatttactgcattgcctatctgatcaatggatttaatatttacggttcttcgttttttacggcattaaacaacggcctgatatctgccgcaatctctttcctgcggacactggtgttccagctggctgccgtactccttctgccactgcttctcggcatcaacggaatctggagtgccgtggcagtagcagaacttctcacgttagggctcacggtaaccttctttgtcagaaaccgcaaaaaatatcattatgcctgatcctttttttcgcgaagtctgattaccagttcgtatacctccggcctgcgctcccgcagatgttcatccagcagatgtctgcgttcccggaaacgttctgccagttccggatgttcctgtgcaatccggtcatgtacttcctgccggtgttcttccagcctttttgccagtgtctcctcatctttcccggaaatattgacaatttcctttaaatgttcttccagatgctccagccattcatcctcatccagcgcctccatatgggaccagcgtccgtgaatcagctcctccacatccttatccgatgtcagatgcgcaatctggcgggcaatctgtttttccatttcctgttctgcctccgaaccaaatgcccagacaaattcctgcacccggttatctgcccgcttccgggaggcgcttttttcaacattatccacaccgccctccagcggatacggacgacgtatccccatatccttaagtgcaatatggatggttctgcgcacgcagccttcctccaccatatacccgagtccgagtctgcgcagctgttcgttcacctccgcaatatgttccgtcatataaaaccggatacctttttctttcagggagccataaagccgctccagacagtctgccgccgtaatatcaatactcccgatgcctcccgcatctaaaatcaccgcacgggtatcctcgcggatggcatcctcaatatctttctgcaataccgaaacattggcaaaacacagattactgctgaaccggtaaatgaccacatgctccacggcatggacggaactgctctctttcaggtcccggaaatgactgtgtccggtctgtatgccaagaaaacaccgcgccggttttgccgtacggataatcatctcggtaaaggaaagcatgatgccgatcaaaacaccattgatggttccaagcagcagcactccaaaaaatgcaccaaaaaagatcagacattccgtgcggctgactttccacaaacggactgcaagttcaaattccgtggctccaagcaatgcggagatcacaatcgcggtaagcaccggaaccggaagaaatccgataaatcctgttccgcacaaaagcagaatcatcatggaaattcccgccacaattcctgtcagctgggttttcccctgatactgttctcccattgcggtccttgatacggacccgttgatcggacagcatccggtcagagctgctgcaaaatttccaagggaaaatgccagcaattcctgattgtcgttgatccggtagcggtttttctgggcaaaattattttctgccagaagagtctctgccataatcactactgccaccgacagactgatcgttatggcatctttaagcggcactgcagacagatccaccgccttccaccgcggaagtcccgtctgcacagcacttaatgtctgtatgccccactccctgaccggaagaaactttgtcataagtgctccaaccgccatcagtacgaccgccatcggaaattttggtatcagtttctttgccgccagcagaattaccagtgcaatcacacccattataagggacggaacatggatctgtccaagtgtatttccgatatgtccggccagctccaaaagttctccggtgcccgcagtcccgccaaacagtttcggtacctgcatgagaataatcgtcgtgcagattccggtaataaaaccgcccatcaccggtgcagatatgtaattcacgagttttcccgctttcatcagataaaatgccagaagccacacggccacaaacagagtcaggaccggcacaactttaagtgctgcttctgaaccgctttctatgtgcagatcaatcagcgctcctccgatcagtgccgccggagctgcatccacaccaaaaatgaactgtggtgaagtcgaaaacagtgcaaacaacaggatcggaaacaccgatccatacagaccgtataccgccggaagaccggcaatctgcgcatatcccatggaaatcgggatggaaacggccataatgataattccggcacaaatatctttcggcaggtttttcttctcataatgctgcagtgtctgtgcaattgttactctcatatttcccctactttcttgcaatgcggtgcagctgcggccgcagcgtaatctctggcacaaccatgccctcccgctggtcaagcacataggcaaccgcctttgccacttcatccggcagcagataactttccggctcctccccacaggtaaaatccgcatcccggtacagattggtatctgtcatgtccggatgaatcgttgtcaccttgacaccgtacttgcgtgcttcctcaaacagactctttccgaagctggacagtcccgccttggttgccgcataggcacagccatgcggactgctctgcttggccgtcacggacgagatattgatgatatatccatgatttttcttcagcacccgaagcagccggttcgtcagaagcaggggaatctctaggtttgtacggactagggcctgtatctttttgggagtcagttcctcatgcagaccataatgtccgactcctgccgcattgacaagtacctcaatgtctgccgtttttgtgatctctttcaccgcatcgcataatttctgttcttctaataaatcgccttctaccggatgaaatgccgcggtctgctctacaaattcccttgtctgttcttttgcaaaatcccgtccaaatccgtagacttcataccctttctcacagagtacccggctgattgccagtccgattccggaactggcaccggttacaatcgctgccttactcatgatatatgttctccttgtccattctctgtgttaattccgtgatcataaaactttccattttctttaataattccggtggatactgatataccccgttgcaattgacataaggatactgtaccgctggtgcaaaaggttctacccgccggagttttttcatatattcctgtgaaatccggaacgttcccacacttacatcaaccagtttctcccagccgtcatgcaacatacggtcaccaaaaatacggtcaatctgacttagcaattgcagataatcggtcttccaggacggcagatacagcatcggatcaaagcacaggcgcaccggaaatccttttttaagtccctccgcggcacagactatgcgtgcaaatgccgaaggtgtttctttctcaaacgcatctatcatcttctgcggagacagggtaaacgcatagatcacattggacagacagggcagatcccacatcgcatggccggcacattttgtccggatttccagctttaagttttcatgttttgcagcatatgcactccagagtctgacatatcctgtcacagcctccatggcaagcagatccgcatcgtaagaaatgcacacatacatattctgtgtcttcagaatatgatcaagttcttccaggtaatcttcgatattcacaaaaagcaccatgtgaccggacggatacatgcctttcagataacagtagctgcaatcatagatgcagttcatcattgtggaacagtaataaaaattggtattgccaaaatcctgacagaccggtgctccttcataaaaaaaatgatcggttttttctgccagaatgagagcctgtgcctgatgttgccggacacagtcctgtccatgccggttaaatacatccttgtaatgttcaatctccacaatctgtgcctgtggaaaccgcaaaaggatctgttccgtacgcggatgattgcggatgcagcgttccacataaatatgggaaaaccgtgtattataacacacgtgctctaagttcttcaagaatcctctttccttcccgtttgtcttttgccggcagccggcctgcctgttcatattcccggtaccatccggacatggtttgcttcccggatgcttcttttgcttcgcagagtgaatgatacaaaatcatctgccggatctgtgctttcatggtttcagaaccatgcaatgcctcctgccacagctttgcctgttcttctacctggcttctaaatgcttcctgcatactctcctgcctgctgtttttttcctgcattgtcagaagctgccggataaatgttaaaacctcttctgctgcccggtccatgatctgtgaaaaatgttctccactcccggcactctgcggcccctgtgttgttccatgatcggttactaccttgagaaacagcatctggtgcggtgcatagtaatagtttcctgcctgatatattgcagcagcctccatatccaccaggatctcttttcccctgtcccccgccccggcatctttatccaaaaactgttggaaagattcccggtcctgtaccgcgggaaaactgtatagttctgcttcctcaaacggatgccggtataaaatatcgggataaaatgtacgtccgtctaccgtttgcgtcagtttgttacaaagcgaaacagtgccgacaggattatttttcctgccggcacagctcccataattgatcagaaaatccccgctatccggttcttttctggtcgaacactctgccaccgccgtggccgccgcaatggcggatgccccggtaatgacaatctgtatttgattgttttcatccgaaaatacctgaaaatgattctgtgtcatatcttttttcaaagaaagcgcccggatcagttcctttgcctccggataaagagctgtaaatattgtgatcaaatagcctttccttcactttctaaaatgtgtcttgccacataaacaccactggcagatgcatgggacagtgaatgggtcacaccactgccatctccgatgatataaagtcccggataccggctctgcagattctcatccagctctacttccatattatagaattttacttccacaccatacagcagggtatcgtcgtttgcggtacccggtgcaatcttatcgagcgcatagatcatctcaatgataccatctaagattcgcttcggaagaaccagacttaaatctcccggtgttgcggaaagtgtcggtgtcacaagcccctcctcgatacgtttctgattactgcgtcgtccgcgcaccagatcaccaaaacgctgtacgatcacaccaccgcctaacatgttcgataaccgtgcaatgctctctccgtatccattgctgtctttaaacggctcggaaaaatgtttggcaactaaaagtgcaaagttcgtattctctgtgcgaagatccgggctgtcatagctgtgtccgtttaccgtcacaataccattggtattttcatttaccactatgccatatggattcatgcagaacgtacggacattatcctcaaacttttccgtacggtaaacaatcttgctctcataaagttcatcggtcagatgggaaaagatcactgccggaagttctacacgcacaccgatatccacacggttggatttggtaggaatttccagatcctcacagacggtttccatccacttgcttccgctccgtccgactgacacgatacattttttgcacgcatattccgcatcttttgtcgaaacaagatatccatcttctttgacctgaatcttctccaccggggtgtcaaagaaaaagtccatgtggtctttcatctcgtcataaagatttttcagcacaacataattgacatcagtgcccagatggcggaccgatgcatccagaagcttcagtttattctgcagacacactttttttaaatctgtgcccgcggtggagtacattttggttccctctccaccgtgagacatattgatggtatccacatatttcatcagttcaagtgctttctgtctgccgatatattcatataaagtaccgccgaaatcattggtaatgttgtatttaccatccgaaaaggctccggctccgccaaatccgttcatgattgcacaggtcttgcagccgatacagttctttaccttttctccatcaatcggacaatgtctctgttccaaagaacgtcctgcatcaaacactgcaatctttaaattttcatcctgcttcatgagctcataggcagaaaaaattccacccggtcctgctccaataataattacatcatacattcgacgccacctccggctttttattttttctcgcggctctcattgcggtactgcaacggagtcctgtcaaagcattttttaaaggtacggttaaaatgctcaacactcggatatccgacaacatccgcaatattttcaaccgtcatattaccgtttttcagcagagtcttggcacgtttcatacgaatatgggctacgtgctctccaaatgtcttacctgatttatccttgatatatttggagatataaggctctgacagatggaactgcgctgccatgctctcaagtgttacatcctgataattgttctggataaaattaagcatggcggtcaggcgttcatcctgtgccccatcgttttgtgcaatctgcggtaatttatttacagcaaccgtcagcgcatggatggacgctttgatgatatcctcatccataccgacaccccagtaactctttccttcacaggtaatgcccacataggcgattgccttagaagaagatccatgggacaatgcatgttcttcataggtagaaagttcgtagctgataccgaagaactgcttgattgtgttgctcacagcgtccagacgaccgtttccgtttgcatcgacgatggtcttctttccgccaaagttaatttctgtctctgccataataccatcattctgcttgaaatggcaagaatcgattgtaaagtacggcattttgttcatatagttttcttcaaagatctcgtatacccactgtggagaaagttccttgtgttcttcatccgatacctgtttcactgcatatccgacttcttctttcattgcctgcggcagagaaatggagaaattctgctttaagatataactgattcctccctttccggactggctgttgatacggataacatcggcatcgtaagttcttcccacatccatcggatcgatcggcagatacggaaccgtccatgtctttaatttcttttcttctctccaggccattccctttgcaatcgcatcctgatgggaaccggagaacgcagaaaagacaagatctccggcatacggagaacgctcatggacatgcattctcgtcagacgctcatacgtctcacggatgcgtggcatatctgcaaagtccagtttcgggtcaatgccataagaaaacatgttcatggcaagcgtaatgatatcgacatttccggtacgctctccgtttccaaacagcgtgccttcgatacggtctgctcctgccagaagtcccagttcagcatcactgacaccgcagcctctgtcgttgtgcggatgaagactgagtaccacattttctctgtggtgcaaatgcttgcttacatattcgatctgtgttgcaaaaatatgcggcattgcagtctcaacagttgccgggatattgataattgccttgtgtgcggcatccggctcccatacatccagaacggcattgcagacatcgactgcgtaatccacttcggttccgtggaaactttccggactgtactcaaaagagaaatctccctctgtctcactggcaagtctctttaacagctttgcaccatccacagccagctgcatgatatgctctttgtcttttttaaacacctgctcccgctgtgccacagaagtggaattgtacagatgaataactgcatgcggagcccctttgactgcctcaaatgtttttttaatgatatgctcacgcgcctgtgtcagtacctgaacggtcacatcatccggaatcatatcccgctcaatcagcgtacgcataaaaataaactctgtttctgatgctgccgggaatccaacttcaatttccttaaatccgatatccacgagcatctggaaaaactccagcttctcgtcaaggctcatcggctcgatcagtgcctggttaccgtcacgcaggtccacggaacaccagattggtgctttctctatgtaatcttttttggcccagtcgtattcgcagactggaggaagaaaatactgtctttcatacttgtcaaaatttttcatgatgtttcctcttttccaacattaaatattatcaatttcaatgagtaattttaacacataatctctcatttggaaatgattaaatttaagcaattttattgatgttttttattttgttaattgattttgcagccggtgtaccacagatgcctccgcctcagacgcatgcattacctgttctgcgacctgtctggcaaccgaagttacctcattttcttcttcccactcctgcagaccggcatccgggatctcctgttttttctgcagtacataccggttcaggttattgcagtactgcatcagattccggaatccacgcacacgggtcagaagatttttaccgtatgcctgctgctctaagcctgctatggcgatcacttccatacacagatgaagttctccggtgatatccgatgcttccatcagaagatccggccgttctttttttgcctgcaaaaaatatgcctttgctccatccacatctgcccggtcaaaatattctgccagccggcaccggacttctgcaatctctgctttttctcccagcatgcctaccatacacgcatacacccgcagcctgttgtgcctgatccagacatactgtaaaaactccgaaatgaatccgaaaattctccggtgataagaatcctcttcttccactttcacgcgccgctccatttcaaataaaatagaaaacagccattccatataagcatcataaacttctttttttgcaatcagcatatttccgaaatatgtgtgcttttgctgcaccagctgctgaaaatccgccgcataatccggataaatctcctgtatcacacgggctgtttcgtccagatataaaatcttgtggtgagaagcaaatccctcataataagaaaaattcagctgcagttctttcgttgtgatcacatcatactgccgcagcagagaaagaatctgtgcctctgtaaacaattttccctgctcatttaaaagataccggcggtaatggcaggtaccaactacctttgcatgggagtttttccatacccagtacattcccgtcagttcactgtaataacagtttttttcggaaatgtgatctccggtattatctcccacacaaaaagacagcggggacgatttctcatccctgctgtatgacgaagccgccgctcttcccacatgaagcggaatatacaacgggtccggtggcggcgtaaatgccttatgcgtcatcacatagatggcggtctgttgatttttatcttctgcgccggtctccatatttttcatgatacattttcttttcttcatacattgcctcatctgcctgattcagatatacatccatattatactcgctgtcccacggagcaagaatcacaccgatactggcctctaaaggctcccggatcggagatggttcttccttgcataccgccgcaatactctgacggatggattccgcagtgatcccggactcttctctcgtcagcagtaaaaattcatccccgccaaaccgaaacggcagactgtcttccgcggcaagccttccaagcgcttcccccgtctttcggatgacccagtcaccggctttatgcccatatgtatcgttgatgtattttaaacgattgatatcacagaatataaacttcgtattgatatgatactcacaatttctctcataaaacttctgtcccagatcctccattccaaaacggttataaattcccgtcagctgatcgatccggtacaacttctgcagtttcagatttacttcctgatactgcttccgctggatataattttccagtgcataacagatattgcggaaaaaggtttccagaattcctgtcctaaacatctcatccacaccagccaccatacagtatcccatccggtgcagctgataatgcagtggcataaacacctgtaccccgccttcttctatccggttcttttcattgcaccagttaagtacttctctcttacagcttcgataacttttggcttcctgggaaaacagatcatccgtcaaaaaaatctgccctcttcctgccccgaccagatctaagaatctccccgtcgcatccatgatctcttctaaagagatccggctggttacccattcctgcatggaatcgagtttggattttgcgtcatgttcctgcagatttttccagaaaatccggttacggaacgattccgtatcaaatgggacatgctttgtgcagccacaggtattcccgataaaaaaccggtagggaagttccctgtgtaccagctttccatctgccttttcatgcagttcgtgcagaagcctgacagcttcatatgccacctggtctctcggccgttcaatggttgtcatcgtcgggctgaaacattccccatcaaaataccggtcaaaccctgtgattggtatctttccctcgagcgccgttccttttatggtctgcaaaaaagctgccgccatcaggtcatttgcgctgataaccgcctgtgggagttcctcccctgcctcatatgccgcaatcatttttctggcatatgtttccccggagcggtactcataatttccataatctacccattccggcataagacaaagccccagttcccggattttggactctattccctgctggcgcatctgcgcctcataggtatctttcatgccgttaataaaaccaaacgtccggattccatgaaccccggccagatgccgcacaatctgccgcatcgctttgctctgattgattccgacaaaagaaagcccgggaatctcctcttccagagatacacagggctttttactttctatgatccgttcgagtaaccgctgcttgacatctccttctttgaccgtggtactcggatacaaaaatccatcgtacgcctccatatctgccagttcaaaaaaatcaaactctgacttattaaaactgtctcccgatcccagtcttccaaaacttgcatacagatgtatggagtcatggaattctttctgtgaattttccagaccgtgatacatatcacgcaggtactcaccgttccatcctgtcgcaaataccgcaatcttcataatcgcacccctgttctttttccttccccgtatctggtactattataccaccaatttcagagagcgtcatccgtttttcgacatttgccgacatattcttttcctgtttctgcctgttttatgcctttttttgttttcgtcttcgccgtctccgacgcagtttttgtccgttttcctttcgaaagttctggatcgtctcccagatttttgtataatcccgctcgaacagttcttccgagagctggactgccagcgtttctttcggaactgtctcgacaattttatcggccacaaaccgcttgcttttctgcttatatgcatgcatcgcgttcagttcctggatatgcgccagttccggccgccacaaaatctctattttacagttccagtccatctgtgggttactctgcggctcccgcagcatataaaaatcaacctgatcccctacctgttccaccgtaatgatcccccaccattccgggacatgttccttaatatgtgccgcatgccgggttccgaccacgaccagatcatagtcataatataagttgtaatctttcacctggcgatccagccgtgcataactgtccgcatcactcttaatctcaattccgtagagggcatcgtgtaccaccatgaccagatccgcccgtgactgccccatcacctgttcctcaaggattctgtttttcccgtaaatttcttccagataaaatgccagaggttcacggatatctttatcgtataacattattttgccagctttgcatcggcttttgcctggaatttctcattatatacgataaaacgctcatgctcgccctctccgatcagtcctgcctcatcaaaagcttttacagaaaacgtcagtgctctgccatctactttcgtcagttcggtttcacaggtaattttcatgcccaccggggaagctgccacatgttttacattcattaacgttcctaccgttccacttccctcctctaaatacggctgtacactctcccatgcagtcttttccatcaatgcgatcattgcaggggttgcaaatacatccagggcaccgcttcccataacttttgcggtgttttcctctgttaccataatttcctgtgttccttttacgccttcttttaacatatgtaatactccttttcttattttgcattaaataagcgatcgggaaagagtttcgcgatcacctgttctgcataaatagtaacatgatttaaaagaagtgtctacagtttagaaagtttttagaaatgcaccaacacgctattttccggcattttcgcgctcattgttagcactcatcaaaaaagagtgctgattttctattgactttttacaaaactggttttatcatttttattagcgaacatttgtgaatgaaaacaaaggagatgtataacatatggcaaataaacacggatcattatccatcgacagcgacaacctgtttccgattatcaagaaatggttatattcagatcatgatatcttttaccgtgagctgatttccaacggttgcgatgcgattaccaaattaaagaaactggacatgatgggagaatattcccttcctgctgattataaagcaaagattcaggtcatcgtaaacccggaagaaaaaaccttaacatttatcgataacggtcttggtatgactgccgatgaagtagaagaatatatcaaccagattgcgttttccggtgcaacggatttcatcgagaaatacaaagataagtccaatgacgatcagatcatcggtcatttcggacttggtttttactccgcatttatggttgcagatgaagtaacgattgataccctttcttataaagaaggtgcaaccgctgttcactggtcctgcgatggcggtaccgaatttgatatgaaagacggcgacaaaacaaccgttggtacagaaatcacactgttcttaaatgaggactgtctggaatttgccaacgaataccgtgcaagagaagtcattgaaaaatactgttctttcatgccaaccgagatctatctttccaaggccaatgcccaggaagaatatgaaaccatcgacaaggaagatgtaaaagataccgataaagtaattgaagaaatccacgaagaggccaagaccgaggaaaaagaaaacgacaagggcgaaaaagaaatcgtagaagtttctccggccaaggacaaggtaaagattgtaaaacgtccggtaccactcaacgataccaatcctctctggaccaaaaatccaagtgaatgtaccgatgaggattacaaggaattttaccgcaaggtatttatggattacaaggagcctctgttctggatccatctgaatatggattatccgttcaatttaaaaggtatcctctatttcccgaagatcaataccgagtatgattccattgaaggaaccatcaaactttacaacaatcaggtatttatcgcagataatatcaaagaagtcattccggaattcttaatgctcttaaaaggcgttatcgactgtccggatctgcctctgaacgtatcacgttctgcgctgcagaatgacggttttgtcaagaaaatttccgagtacattaccaagaaagtggctgacaagctcatcggcatgtgcaagacagagaaagaaaactacgaaaaatactgggatgatatcagcccgtttatcaaatacggctgcttaaaagatacaaagttctgtgacaggatgaatgattatatcctctttaaggatatcaatgacaagtatcagacacttccggaacttctcgttcctgttgaggacgaaaagaaagacgacgaaaagacgaccgaagatgcaaaggcggaagaatccaagtcagacgatgcaaaagaggaagaaaaagagccggaacgcagcacgatctactatgtaacagacaaggctcagcagggacaatacatcaagatgttcaaggaacagggcatgaatgccgtaatcctcgatcacaacatcgatacttccttcatcacacagttagagcagcgcaacgagcactatcagttcaagcgtattgatgcagatgtcacagatgccttaaaatccgatgatgcagcagatctgaccgaggaaaccaataccctttccgatctgttcaaaaagacactgaacaacgataagcttacggtaaaagtagaaagcttaaaggatgcggatgttgcctctatcctcacactctccgaacagggcagacgtatgcaggatatgatgaagatgtacgcagccggcggtatgggcggtatggacccgaatatgtttgcagcagaccagactctgactttaaatgcaaacaacgctctggtaaaatatctgttccaacacaaagattccgaacattccggcatgtttgcagaacagctctatgatctggccatgctttccaaccaaccattgtccgcagaggctatgacaaagttcgtaaagcgaagcaacgatatcatgttactgttaaccaaataaaaaatggtatgaaaaactccgaagctgtatgcttcggagttttttgcttctatagatattaaaagatattaaaaattacgaaaaatgtctgcggctccatctcagataccccacatgcaccagaattgccacggtcgtaccgattaaaattcccaccattacatcggtcggaaaatgaacaaagtgatacagtctggaaaacgcaatcagtgatgctaaaatcactgccggaattccaagctttttatcattacataaaagtgcgatggatgcagcaaatccgttcatggaatgcccggacggaaaggaataatcctttgggctttttatgagcagggcaatctgtgtatccagccagcagggtcttggtcttgcgatcagatttttcagaatcagatttccaatgataaacgtaattgccatggatatcaccatctggattccaattttgcggtatttcttcggaatacaaagcgcaaggccaagtacaatccagaaaataccggcatttcctatcgtggagagtcctgtcatgatatggtcaagaaccggctgatgaatcttctgcagtgcatataaaatatcaaattcccatttcatgtcgtctctgtattttctcctgttgtaaaatatttctcatatgtgctgaaaaaagaatccgtcccgatgccggacacatcttttaacgtcacatcgtcccacagattatcatttaagcaaaacgtggaattcttcacaaacgtctggtactcgttttcaaatcgttctttttttttctttacacggattttttccttgttttcctccgtcagatctttttcgaatttgttcagacagcggatgatataatacccgtcatctgccgcaatcacatcggaacacgctccgtcatcgagattaaacacgatctcctccatcgcatccggataagttccacgtgcaatggtgcgctcaaactccctcgactgattgtaagcactcgcaaccgaggcaaaatcatctcccgctgcaagattttcctgcaccgcacgcagtgcttctttttcttttacatagatctgttgtacccggaccactctggcttcatcatcactgatctcctcatcggttccctgtgtcagcgcatgatacagcttttctgccagtgcatactcttcatatgctgtacggatctctctctcatacagaccgatgaacgttttttcttcctccgtaagtgactggtaatattcttttgccgcacgtgctgcctgtttcttttcctgctcactcagatgcatgtcctgattttctgccagaatatccatacatgcaatatgtgtcagttcctgaaccgtcacatccttaacatactgttctaaatccgcatcataggattcccagagatccgttccatacgctttgccatacaggttgcggtaattgcacaaatacagttttgcatatctaatatcatatttatgatcattgatccgcacaatggcattatggtttctcagctgccctgacgacaggcgaatctgtgtatttccaaccttacagcctccgagtgacggtaccgtaagcgctgccataagaaaaatccccgccagtttccatctcttttttttcataccgttttatccttctacgacaagaaaacgaccatcaggaatagcaaaaacctcacttgcctctaacagttcttcctcactcattccggcgacatccatccccgcgtcatcaaaataatcccgcacttcttttatatttttacagacaaccgccatgcagtcctccagaaactcttctgcttcctccggactttccgctaccgcctccgggaaaagttgtgtctggtgttccagaaaataatgtaaaatctcctcatcgtattcgttcatacctttttcctccctgtgaatcactttctattattataacgaaggaatttctctgtgacaatcccttaattccactccatgactcccagttttttcagttcctgatataaccgccccaccggaagtcccaccacattgttataatcaccatggatttccttcacaaaagcagctgcctgtccctgaattccatagcttcccgccttatccatcggctctccgctggcaatatagcgccggatttccgcgtcatccaaaggatacatgcagacatctgttttctcataaaatgaagtttccccggttctgccgtttttatcaataaaaacaagcgttactcccgtgtatacgctgtgggtatgtccggacagcatcgaaagcatatgggctgcatccgcgtcatcccgcggtttcccgagaatatttccatcacaggcaaccaccgtatcggccccgatcaccagaatgtcctgcggcgtaaccagctccggatggatttcattgtaggaaagaattcctgcggccacttcttccgctttctgacgggaaagttctaacactgccccatccacagaaccagcagtaatgacttcttcgcccttcgccggacaaatttcaaattccagtccgatctgttcgagcagctcttttctccgcggtgacgcagaggcaagtacaattcgactcataatgtgacaacctccttcaggtgaaacgaatagatgagtttttcttccgccaccattttttttgtatccgtagaaaatacacggcttaatgcatctgcatacagctgaagctgtgtctgatagcgcatcaaaagttcctgcgcctgttttacccggtccgtcttgtaatccagcaaaataattttatcattttccatccagaaaacatctatgattccctgtaccagcaccgtcccgccggatgcctccatctgatgctgcatcacaaacggtcgctcccggtacagatccccacgcacagctgctgctgccatccggggagcaatcggactttccacaaacgcttcgatcatttccggaataacaagcgcataccattcccccggcagttgtccgtttgcaagcatccggtccagttcctgtttcacaaatgcagaaactgctcccgcatcagaggtatctatatctgcaatcgcagcaaaatccagacattccatcacccggtgcaccgcggttccccgcatagcaccctgatttacgttttcagctgccggatactctctgtcctcttctcttgcaaagtccggaacatacacttcacggtcttcctgcagaaaatccggcaccacggcttctccctcggacctgtcatactgtaagacaagcgatgcatgcttcagttccgaaaccgaatatttactttttttgccggcctcactctgatatgggtaacggtaggaaaaccactggtcatactgctgaagcagttccggtttcgcatgatcgatatgctgcagaagttcctcataattttccctgctgtctgccgcctgttccacctcttcccatacaattttttccggtggaaccacatcgagcgtatatttctgcggataagaaagcatggccggaagaatccagtccaggtaactggctgcccggaccctctgccggtaactgaccggcttccccggaagtacatttccggtatatccggaaaacgtttttggggcatctttgatcattccggtcaaaaccagtttttctttggctctcgtcagtgccacatacaatacgcgcagttcctctccaagattttccctgcggatccggtccgcaatctccgaccggaacacactgttttttttcactctgggctgcccggaaatctcacagattccaaggcctaaatccggatgtaccaccagccggtcactggaatccatctgattcatttttcttcccagaccggacacaaaaacgaccggaaactccagtcccttactcttatgaatggtcatcacgcggacaacattggcattttctcctgtggtatctgcctccccgaaatccacttcatatttctgaagcttatcgatataacgcagaaaatgaaacaatccccggtagcttgttttctcgtaatcaaccgctttttccaccagcattgcaagatttgccgcacggcgctcccctgctggcagtgccgccgcataatttccatatccgctaagttgcagaatcttctggatcagttcatggatcggcagatcctgtttttcccgcagcttacgatacatccggtaaaagtcataaagtgcgccctccgtggcatcctgcatggcatgcattgcagcttccgcaaacgaacactccggattttccacacgaatctgtgccatctcttcctcatccagtcccaccagaggagaccgaagaaccgccgccatcggaatatcctgatagggattatccagaatccgcagcattgccagcaccgtctgtacttccgatgccgaaaaatatccggtcgaagactccacatatgccggtatccccgctccctgcaggacctgcacaaaatccattccgtagtcttttaaacttcgaagcaggatgacaatatcggaatagcgcagcggccgaagctgtccactctccttatccgtcacctgcatgtgctgcttcatatccgcaatacgcgtggcaatcatatgcgcttccatctgtccttttgtcagattctttgtctctgaaagcaattcgtctttttcatccaaaagcaaaagctccggtttaaatcctttagcattctcatcataattttttgccccgcaatacaatgccgcatcccggtcatacgcaacccgtcccagatccggactcataattttgtagaagatatcattacagaaatcaagcacctgtgcacggcttcgaaaattcatatgcagatcaattctctgctgcagactctcttccgtcgaaaaagatgcatatttatccataaaaagttcggggcgtgcaagccggaaccgatagatgctctgcttgacatctcccaccataaacagattatgcccgccttccggctccatggaaatcgcacgcatgatctcttcctgtacctggttgctgtcctgatactcatcaatcatgatttctgcaaaatgtctgcggaattcttctgcggtatgccgtggctgctttgttttttcgtccacgagaatccgcagagcaaaatgctcaatatcggcaaagtcaacaattctcttctttcgttttgccgtttccattgcctgtgcatattcaagtgccagccttaccagctcttcgagaaacggacacaagcgtgtctgctgcaaaagcagtgtctccagatccatcgcaaaatattttttctgcagcgtttccacttcttttttcacatccgaccggatctccatgaccgtttccttttttttgacatccccggagaatttgcggatcggtgacaattttccaaagaccagaccatttaaaaatgtctgtacctgcagatatccctgcagattttctgcctgctgcagctgcgtcagatccgcttccagtgtctttgcatatgcctgcggtccatccggctcattacacaactgcagtgcctgtgtcatctgtgtgcacatgtcacacaacaaaagcctggcatgttccgcaatgtcctcaagcatctctgtctgcaccagttcctgtgcatgttccacctgatacggttcggtgagttttttcatccacgcctgcggccacggactactcaaagacatccggtaaatctttgccaccatctcccgcaccccgtggtcgtttctttttccggcataggcatcgatcagtgaaagaaacgtcttttcctgccgcgcatagttatcttcaaacacctgctccagcacgtcctgctccagcagccggatctctccttcatctgcaatcctgaaattcgggtccagactgatctcttcaaaatgattccgtaccacaaaaaggcagaaactgtcaatcgttgtgatcatggcattgtgaatcagtgccgactgtctgcgcaaatgcgtgttttggggatctttttcacattctgcctcaatggcagccccgatacgctcccgcatctccgccgccgctgccttcgtaaatgtcacaaccaaaagccggtcgatatcaaccggcttctgcgggtcgagaatcctttggataatacgtgccacaagcaccgctgtttttcccgatcccgctgccgccgagacgagaatatcccggtttctgaaatcaatgacgttctgctgttccttcgtccatttcatctgatcgctcctcctttcccctgtttctggcaagctctgtctgcatctggtcaagcacttcttcttttttcatggatgcaaactgccggtattcatatcccggaatttttgcatccatcccgcacaccgatgcatatggacaataggtacaactggtttctatatcactccggtaaggattcaccgcaatatttcccgcatagatggcctctccacactgccggatctcgtgctctacatagcgggtaatcaccgcaaactcttccgtcgatgccacttttgaacgcgctgtggaaatttcaccgtttttcttgatttccacagggatcatctgcgattttccctcaaaattctgatccatggcacgatagatttcctctccggaattcaccagtccatccggacgcagtgcgaaaagcagcgcctgctcggcctcttcttctgacaatggagtatccgattcgagtaccggatcatcaatgtgataatagagaattcccccgggaaggatttcttttttcggatgctgtccccgcagcatttccatcgccgcatccatataaaccaccagctgcagctgcagtccgcggtacacacggatcagatcgaactttgtatttccggatttatagtccattactttaatcgaaattttattttcatcttcaaaggtatccagacggtcaatccgtccttccaaccgcatggtcacatcatgcgataaccggtactcgagactttcctttccctccagttcgtcaaatgtcacctcaaatttttccggtacaaactgccccgcacgcacctgtctggtcaatgcccagaccgtctggtcaaaaatagcaagcatccgttttctctgataggcattttctgccgtatcgcagaccgccatacccggatacccggcaattgcctcctgcatggcattctctgccatctgccggcgcacggcatccggcaccacaaaccagtcatattccgattgttccagcttccggctgtagcgttctaaggccgtatgatagatatttcccatatccacactctcaaatgcactggtctcacgctccgcgagttttaaaccgtattgcagaaaatgtgcatatgcacaggcagcaaaccgttccagccgcgtaatacttccgtacggatgtcttccgtacagtgcaagtgcaaccgcccggctgattggctctccctcataccgtgtatacggcgcatgcagaagtttacggatcttctcctgcttttgcatatcattctcctgcaggaaccagcgggcaagcgcataccaggcttcttcgtgcggtccgaagacgagataatcttcggcagcctcttgggtataaaaatctgtatgcgcctccatatgctccggttcctgcaatttcagtgtcggaaacagtttcctcaaaactccggtcagataagaaggacggatggcttttccctcactgtcaacctttgcataactgacatataatttttctgaaggtttggtaagattgcggtacagataaaagcgctgaataaatgcctgctctcttgcccccggtgctaactccactttttctgccagaagttctctttcgtattcggaaataattcctccggcatttgccgccttcggaataataccgtcgttcacaccgataaaaaataaaatcctgatatgatttaatcgtgtacgttcgatatctcctatcgtaacactgtcatagcccggtggaatcacagccacgtctgcagcggaaagtcccgcctccagcacttcggtaaaatcccggatctgcaatggttcctcccccagtaatagattatatttttccagaagttgcatcacgattgtataaatctgtgcatattcccgggatctggtttcctctccctgcgccagaagctgctgttccctgttccataactgatgctgggtgtccagctgtgtcagcagctgatacaatgcccggatgccatccgaaacacgggcatcttttcgggcaaatactgctgcaaacggctcaagatacccatatattttttcccggagtttttcgagctgttccagatcgtaaagcgttttctgccgtggcatatgcccccatcgtctgctccacgccgctttgccgcggataccggttgcaaccagataactgtccagccggtccagatcgtcctccgcaatatcacagaatccacaccgcaaaaagcgcatgactgcctcataactaaaattcgtatccacaatttcaagcgcggcacgaatacattcaatgaacggatgaaataacacttctttggtcgtatccataaaatatggaatctcatatttcgtaaaaaccggatccatataactctgataagcttccactgcgcccgtcaccactgcaatttcccgatagcggtatccctgtctgatcagcgcattgatctgcctggccacaagaaccagttcttcctgtggattttttactgcggcaagatggatttcttctaccggcttggtatattttgccggacggggacgaaacagattctgttccataaatgccagtgccggagccagcttaaaacgcttgtgtgcactgtctgtcattaccaccggttccatcacctgcacatgaagttcttctgccatcttcatcaaagacagaatcgtttttttggacagtgcaaataattcttcatttccactgcaatgataaaaatcttctgcagcatcgattgtaagcgtaatgtaaatatgctctgtcacctgcagcaattcccgcatgagatcattctgtatcggtgtaaaaccggtaaactcatcaaataccagcaccgcatcccgcaaagtttccgactgcggcacaagatttttcagaacatttaatatctcttccgccgtcacaaaactatctttcataaaatcacaaaaagcgcgatacatggttgccacgtcgcgcagttttgcagaaagtaccggtgagattgttttgtcctccgtcagatccaccagctgttccggtgaaatccggtactgcaccagctctgagatcattgattttacttccccgatatatcccatccggttcatatttgcccgaagaacggtaagcgtctcctcctgttcctgtgcaagcctgcgcagcaccaggttttttccggtttcttccagaacctgtatgtcctgcatccccatatcatcaaacacacggtatgccagacgcttaaaacttaacacatcaatgttcataattgcatgattcggtgcaagttccaccagtttctgctgggtctgcatcgtaaactgctccggtacaatcaccagataatttttcttcggatgttcccctgcctgccgcaccagacgctcatagatgtattctgttttcccgctccccgaacttcccagtacaaattgtaaagccataaccccctcttttttcccccttaataaatatgtgaaaagatcagcgataccacaaccgtcatcagaccggagactgcaattgacagactgctcattgccccttcaatctctcccatctccattgcctttgatgttcccatggcatgcgaagcagatccgattccaacgccttttgccaccggatcgctaatgtgaaacagtttacagatattctcggcaaacatatttccaatcacccctgtgacaatgataactgcaaccgtaatggttacaattccgcccagttcttcggacaatcccataccgatcgccgttgtgatggactttggaagcagtgtgacatactgtttgtgtgataatttaaaaatcagtgacaataccaacacacacagcgcagaggtcatggcacccgcaaaaattcctgcaagaatcgccttccagtttttcttaagaggctcaatctgctcatacaaaggtaccgccagcgcaaccgttgccggtgtcaggaaatacgaaaggtatttcgccccactttcgtatgtgtcataatccacatgaaaaatcagtagaaaaataatgatcagtgccatggaaatcaacagtggattaaaaatagcgatctttaattttttcttgatcaataccccgatctcataggtaataatactgataaatactccgaaaaatacagagttctgtaaaaagttattcattcttgtcctctttctttccatgatgcatcatctgctgtgtaacctgtcctgacacgcccataaccagtacggtagaaacgagcagcagaacaatgaccggaagcagaatcggccgcagttctccccagctgtcaatcagcccgacacccgccggaataaacatcagcggcataatctcaatcagaaaccgcgcggcttcatgcacctgcggcaatttgaccagtcccgtcatcaatgcaataaataaaagcaccagaccataaatacttgccggcatctgaatcggaatcaccgcgtgcaggacttccccgataaacgagaaaataagaatcatcaatagttgtcttaaatacttcattttttaactccttctttcgcttttcccattttagcacctttcaggatttttagggcaaaaataaggattgtattaataaaatacaatccccatttttaaatccttctccctatttttcctgtgcgttgcaatcctttacatactgcataatgatatctgccgtaccttcaattccaaaccgcgtatcattaatgcaaagatcataatttgcagcgtacccccagtcctccccggtataatacatatgatactgcttccgtcggctttccgtcttttcaatgacagactccgcctcatgtcttttcaccttatgcttctccatcaggtgatgaatccgggattccctgtcaccacttaaaaacacccgtaccacatcgttttccttctggtacgcataatttccagctctgccaatcagaatacacgatgtctccccaatcagttcatccagaactttcctcggtgtccggtgcacaacactgtcttccccatcatcttccgcaatgactgccagaagcgttcctgccggattctcaccgaaataatccggataatgctccagaattccctttttctttgcgagttctgttaatgtctttttattgtaaagtggaacattcagtctgtctgccagaacctgtccgacttcatctccgtaacagccgcactctcttgcaattgtaatcttcatgccgtaatccccttctttcctgttaccgcaatgttagcacaattttatccagaattccagtcaaatgtgcaattgtaatcccataatttgtcatcggaatgttctgtgcctttgcgcggtcgattcttgatactacatatctgcggttaaacatacacgcgccacactgaataatcaggtcatacccttccagatcctgtggaaaatccgtgccgctcacatgatcaatccttagccgttctccaaatcgtttccgcagcatacgcggaatttttaccctgccgatatcctcgctcaaaggggcatgcgtacagcattccgctatcagcacatgagagttttcgttcattgcatcgatctgtctggcaccttccatatagtacggcagatcccctttgtatgcggcaaacagcacagaaaaagatgtcagcatactttccgccggtttattctggtatacataatcaaacacctgggaatcggtaataatcagctttggtgcctgctgcagcatgttgagtgccggaagcagtttgtccgtggtcacactcataaccatacactttttatccagtaattcccgcagcgtctgcacctgcggcagaatcagacgtcctttcggtgcctgaatatcctgtggcataacaagaagcacaagatcttcctccgtgaccagatcccccgtaatcaaacggtttccaaaattctccggcactctgcggctcattgcctcccggacattttccataccagctccggtcaatgcactgactaccagtgcatcttcctttgttttttctttcagatagtttttcagaggtgctgcatccgccacgtccgccttgttaatgatcagaagaaccggaattttacgctccttaaaccaggtgtaccatttcagttcttcctcataggattcgccgcaaaccggacatgcagaaaaaacaataattgccagatcagctttttgggctgcaagccgcgtccgttccacgcgctgttctcccagcgtactttcatcatcgaatcccgccgtgtccataatcgtgcacggtcccatcggataaatttccattgccttgtataccggatcggttgtcgttcccgcaacatctgcaacgatggaaacctcctgtccggtaaaagcattgataaatgaagattttccgctgtttgtttttccaaatacaccgatatgcagacgatttgcagacggtgtttcattccatgttgcacccatatgcgttctccttcttgtgcgttttgctgaatcagtgataatctccacggtttacgaccactttgtatccgacactttccatgcggcgcgccatacagtgccggcactctgccgcctcatctcccgtacagattttattatcatataatttatatttttcccgcactgctaccggggaaagattcggcatcacaacatttgcccctgcctgaattcctttttccctgcccagcggatgaatggttcccagtgcagttgttgatggcagcagcacatgcggctgcaacagccggataatggataaaagccgaagcgtatcttccattgttcctgcctttttttcgccaaatggggtatccttctggggaataaacggaccgatgcctaccatatgcggctgcaatttccggataaactgcagatcttcatacagcgtatccaccgtctgctccggcgaaccgaccataaatccacatcccacctgataaccgatttcttttaaatcccacagacagtccatgcgatgtttccagaacatttctgccggatgcagttttccataatgcgcctcgtccgcggtctcatgacgcagcagataccggtccgcaccggcatcaaaaaatgcctgatagctgtcgtgctctttctccccgatggaaagcgtcaccgcacaatcgggatactgtgccttgatctgccgtatcagggcacagattttatcgtccgtaaaatacggatcttcccctccctgcagcacaaaggtccgaaatcccagttcatacccatttgcacaacaggaaagaatttcttcctccgtcaggcgatagcgttctgccttgcgattgctctttcgaatgccacagtaaatacagtcattcttacagtaattggtgaattcaatcaatccacggataaacacctgctttccgtaaatggcatctgctgtcttacgtgcccgctcgtgaagaaatgcaatgtccccggtatccgttgtctccagcaacagagccagctgttcacgggttatattctgtctgttttcaatttccgttatgatctgctttaacatttgcatacaccgttctggcacttgcgccatccaatctttgaatttttattttgtggattctttaagtactacttcatacgacaacagtgtccgatccggtaccgtctccccttcaatctgcgccagcagattcttacaggcttccattccgagttctctcgcattgaaagacaacgaagtgatcgatggtatattgttctcgagcacggaactgttgtaaaacgatgccacacggatatcctgcggcacttttatgtgttcctgccgcagcttgcgaagtacctgtatgcagatggcatcatccatgcagacaatacaatccgcccctttttccagcacttcttccactgcacgatccataaaggcacagctctccaaattccggtaaacaagcgtttcttccacttctcttcccgcttcctgatatgcctgctggtatcctttataccggttctggttgactacgaaagattcacttcctccgagcagagcgatatgcttcatctggcgcatcagtaaaatagatgtcagttcgcggcaggcgctctgctggtcattgtccacctgtttgactttgcggtaggtagtactaccggttgtaacaaacggaatctttttctctaaaagcagttcaatctgcgggtcttttaaaaaggtccgcagcagcacaatcccgtccaccttgcggtttctcacgacgcgttcaagacctgtaatatcattttcctgacagatacacaacagaatgtcgtactcattcattcctgcaatttcctgaattcctgtaatgacttcctgaaaaaacggaagatctaccagtgcataatcctccggcataaccacgcagagattgaatgtttttgactgtgcaagtcctcttgcaattacattcggtttataatcatgctcctctatataagccaagactttttgccttgttgcctcaccgattcttccctttccggatattgcccggctgactgtcgttttggaaacgccaagtgcttccgcaacatccgaaatggtgattacatttccctttttcatattcttctcctaactgcacacctatgcatccattgcatgttaaacggttgcgcagttacattttgcagttttttatcaattttgtcaagtatcccctattcctttgaatttttctgcaatttttgtaatttttcttctgctttctttaatttatcataatttgtgacatacaccttatcattggcagtcagtttctcatacgcatttcttgccttttgcaccgcttctttggaatcctttgtaatggttccgagtgcgtcaatcagttttacgaccttttttgcttctcccttatctgttgcatcggtactttccgttccaggaagttcatacaccagcaccggataattcttcttaacattttcaaatactacctttgcgacttccggcggaagattgatgcagccatgtgatcctgcatatttataaatacttcctccgaacttgctgcgccagtaggcatcatgcataccgacatttcccgcaaaaggcatccagtatgtaaccggcgtctcatagttttctccgcgcaaagttgcatttttctcggtatatgtcacgccatatgcaccggtcggtgtcgcattatttttcgatacatttcccgatacaaaatccgaatcaatcaccagttttccatctttatataagaacatatgctgtgccgtcagattgatctcaacgtaagaatcgccataatcattttttccatgggaattggctgtcatggaataattcagttctctttccactgttttcccggctttgatctcactcgtaatctgggcgatttccttttccgtatcaatcttccatccataatggctctccggaatcgtaaccgtctttccgtaagaagtctttaacgttttggcactgtaacaggtattatatttttttgcaagatcactgacgtatgcttttacacactcctggtccagtaccggttttaactttttatttaaccggaaccagtcaccaaatacggaagcatcaagtacctctttcgcatctcccacggtaaatgtaatctttgtctttgcatatccgttcattttctttacggcttttgccagattcccatcatcatctaaaaccgtcggatctacataaacaccggctttttccaaagagaggttctcttttaccccttccactgccccctgcactgcctggtacattttttctgtatcaattgtcgttcccatgacgcacccaaccacggtaaatccttccgttttatcataagaagaaaccgaagcattctccggtgccgtctgatgctctgcatccatacagtccaatgcatcgatctgtgtctgcagcttatctttgtcatagtcgacaagtgttgtatttttcaatgtctgtttctggaaaatttttaccggccatgcaaaaatattctgtgcgtgtaccagctctgttatttcgtctccccactgtggttccagcgaaatatcctgtccggaaattttttctgtatgcttgtctcttgttgctatctttaactggtaggaatggatttcttccgtaatctcatccatcactttctgcgcggtataccctcccgcttttcttccatttaatgtcgttttcgggaaaaagtgattgtggaaataaacggccagtcccagatacaaaagaacggccagtcctgccaccatccatatcagttttcttctctgttttcttttcattcgtgcttttttcaaaattcttatcctccgtcactattgtattatacaaaagcacaagaggttgtcaatgtgccaaatttttaaagttttatgaacattgcgggttttatattgtcgtgcttttttccccgtgctataatcaatttcagaacaaaagaaaaaagatctgcacacaaatataaaaggagtatttatgttgccggaaacccaaagtaagcggacgtttgtgttccgaaaatattataaaaaatataaacatttatggattttgttatattttttcgtgtacatggcatggtttaactatgtagaaaaaaccgtcacgacacattttcatgtcatccatgtaccgattgatgattatattccgttttgtgaatactttgtcatcccttatctgctctggtttccttttgtcggatggggcatcgcctatatggcattacataataaaacagattactataaattgtgtgcgtttttgtttaccggaatgacaatctttttaatcatctccacggtatacccgaacgggcagtatctgcgtccgacctatttcacacaccacaatctgtgcaccatgctctgtgaacgcctatatgccggtgatactccgacgaatctgtttccgagtatccatgtatataattcgctcggcatttatcttgcggtgacacacaataaaaagctgcgcaaaaacaagctggtctgtctcctgacactgattctgacggtcagcatcattctggcaacgatgtttatcaaacagcattctttctttgatgtatgttgtgcatttgttcttgccgcagtcatgtaccatgtggtttaccgccacaactgggcgcgtgctaaagctgccgccacctcatccaaaaccgataacaatttttctgtggaataataaaggagctggcctctctggtcagctccttttctttttccttttattttttgcgttctgccgcatgccggtacacggtttccatggattgaagaagttcatcaaaatttttcttctgactctccatttcttctgtaaaatcctccatctgcatccggttgcgttcctcggatttggcaatttcctcatctgcattgcgaagcacaacaatctggttttccatctctttgaaatttggacatggttttaaacgattccattcctgtgcctgacgcgcagcctcctgacaggatttcatcagtttggtcattgcaacattgttttctttcagcaatgtaaccatccggtgtacctgctcttccagctctgcaattctctcatccgaatctgccagcctcttatgtgcctgatcaatcagctcatcatacgttcccgcagatacacggatcgtttctgcagccgtaacaaactgttttcctccctctcccatacgcccggcttcaatcgccgcattgagggcaagcactcccatctgctttccgcaatcctgcatcttttccagttcctctcgggtcttttcattttccgccttgagtgcaaccggaaattcgttcaggaatttggatggcgtggtgaaatgtttgttttcctccaccagctgtgccatctcctgttcgatctgtgcaaaattctgcagcatctgctctcttttttccgatgactgtacttcctgctcctgatatgacgccagctgtccggtcagctcctgctccttttctccgttgtctgccgccatttgtgatgcttcttttatattttcctgtatctgggtgattccggctcccagctgctgatatgtatttctgatttcccttgcggttgcatcaaacatatcttttccgtccttcatatgggcaaaaaagccttcatccagctgtgccaggtttctcatccgtaccagtgtttcctgtttttgtttcttttttccgaacattacttgccctccattgcatttattttacaatttctttcccgttttttcaatggaatcagcgataatatttcatctccagctgcagattttcatttccctgataaaaatcaatctttgctgtatacaccatagaaaataaaatccggttttttctgccatgcagcgcattctccacctcttcctgaccaaacttttcggtaaaatatgcaaacaacgtctccacatccccaaagaaaataaccggaaccggctgtccgtattccgaaagaacactcatccgaagaacattccggttctttcctatcaaccacatgcggctgatggacagattccggtctgcaaacagtggagatggattgtcttttccaaacggctccaaaagtgcaaactgatggaccagttccgtactcgcatatcccaccggcatggccatgtcaatgtgaatatccggacagacttcctccaccgtaagcggacagttttcattgatttttctgcggaatttttcaacattttcttccggaagggataaccctgccgccatcggatgtccgccaaattttgtaaacagttccgcacatccacacatattttcatacatggaataattttccgtcgatcttccgctgcctttgactccctcttctccccgcgtcagcacaaataccggccggttatacatttcccggattcttccggcaatcagtcctgcaatgctttcgtggacatccggcagaaacagaacaagtaccggatcattctcatatccaccttcctcacagagtttctttgccatttccacgccctgcagtgtcaactccttgcgttcctgattcagatcaaccagatcccgggcaatttcttctgcctccgtttcctgcccggtctcaaacagccgaagggcatgccttgccgtgtcaagtctgccggttgcattgacacatggccctaagacataaccaaaatggtatgcactgatattctccggctgtacattgcatgcctgcataagtgcctgcaatccgatgtttttcgtatgacggattctctttaatccctcttttaccagaatacggttttccccggtgagcgacatgacatcacagacagttgccatagcaacaaaatccagcagatcttccgcttctcttttgtccatatcataattttcatacaatacacggatgacattccatgccacaccggcgccgcacagctctttatacggatacccgcagtcctgctgatgcggatttaccacggcatctgccagactctttttctctgttcttcttccctcatgttcttcaaacgggactgcatggtggtcggtcacaagtactgtcattttctgcgcttttgcccacgcaatctcatcgatagcggcaataccgttatcacaggtcagaattgtatccacaccatcttctttcgcctgttgtaataaatgcaggctcagcccatatccgtcctgtatccggtgtggaataaccacgtccacttttgctcccacacgccgcaaagccgtcagaaacagatgggaggaagtcacaccatccacatcataatcgccgataatccggatatgcacctgtttccggatcttttgtgcaagaatctccaccagccggtccatatctttcatctgatgaggatctgacaggtccgaaaggttcccacccagataaatccggatatttttttctccgattacctcgcggtttctgataatccttgccacaaccggatccacatgaaatttctctgcaatcgcataaaaatccgcttttttagcagcgaccatccattgtctcatatgtcactttctccaatcgtaatccctgcggcggtgccgtatagcccgcctgcttccgttcctttgccttaagaagtgccggcatactttccggagcccgttcgcctcttcccacttcaatcaatgttcccgtgagaatccttaccatgttctgtaaaaatccattgccacaatacaggatctcaatctcaccgtctctttccaccagatcaatggaaaaaatggtacggaccgttgattttttcatatgacggttcccgcaaaaagaagcaaaatcatgcgttcccacaagtgcctgtgccgcttttttcattttatccacatcaagcgtttgtccatactgatacaaaaattttcgttcaaatacattcggcaccggacttgtccgtatccggtaacggtaggtcttttccacagcctgatatctgctgtgaaaccggtcatcgacctcctttatttttgtcactgcgatatcttccggaaggtgccggttcagatcttcaaaaatttcctctgccgaaaaatgttcgtccagatggaaattagccacctgcccgattgcatgaactccggcatcggttcttccggaaccgatcacttccaccggatgcccggcaagcgccgaaagcaccatctgcagctttccctgtatggttgcatcggtgctttttaatacctgccatcctttatatctggtgccatcatatgacacggtaattttataatttttcatccgtatttttcctctcttttatacaagttctgcgatacgggaaaccgcaacataaatatctgaaattttataccaggtcggatagtccacaataccggttaccggaagtccgaaaaccgactgaaacttttccaccgcttccctcgtccttgatccgtaaactccgtccgccgtaatcgtcggtatcgccggataagcacgcgaaattcttgccagctgttcctgcagctgacgtacctttggtccgcttgctcccacgcccagatcatatcccggccaggatgccggaattccggaaattccgtccgcggaattaatatacatatcatttccgtaataactgcgcagaatatcaatggcagaatatccctgatcacccagatatttgcttccccactgcgacatccagtccggacaggtcactctctgtccgtcacagtactgtgtcagaattggctgacggacatttggccgggacagataattttcaaacatttcatccactacctgtgaaatactctggaagaaatttcttccgtaaataaatttgtgatcgtatgccgtggaagatgtgatggtaaacacataccctttgccccggtaccattccgtataaacccggtttaaagtaaatgacataatagccagcacattggcacggattgtggcatccggccaggtcgcatagatttcactggaagctacatttttaatataatcccggtagcgcacataataattcgcagctgtagaatctcccggtgctccgtcatgtaccacaacatattccggaattactacacggcttaagacaatttctccggtttcttccaccgtcttaatctcactctccggaattttcggtggatattctccatacagggtatgtgcatcaatcacgatcgtatcaatcggatcgcccggcgcatcctgtgcctccattaccacttcctgcgtcgcatcttccccggacaggatattgatcgccgaaaccgtaatgtcccgatagcctgtggcctgcaccttgatcgtatattccgcatatggctggttttcacccggctccatggagtactccagtggaggagcatcaagcgtaatcttctcagtgtttccagaatcgtcggtatccacctcctccagcacctgctgcggacctcccgtataagatatggtaatccttgctcctttcaccggaattcccgtcgaagcatttgtcaggtgaatctgaagcgttccctcatccacctgattttccactctgttctgatccatacatgatctccctctcttcctgccagaaaacctgccacgtttctctgcagtggcacaaataagttccagacagctgcatttgattcatagtatgcatcttgtaaaaaaaaggttacactgttatactgttgatacataaaataaatcaggaggtttattatgcacacatttcaaccatatccaatcgataagatggaattcaatccatttaccaaaataggaaaagaatgggctttagtttccgccggagacaaaaccagatgcaacactatgaccgtcagctggggaggtgtaggcgtcctctggggaaaaaacgttgtatttatttttatccgtgattcccgctataccaaagaatttttagacaacggagatctgttctctttgtctttcctgaatgaagactaccgcgatgcgttaaattactgcggcagtcacagtggccgcggagaagaagacaaattcgccgctgccggactgacaaaggcattccggcatgacattccttatccagatgaagccaatctggtatttttatgcagaaagatggctgccgtaccggtcagcgaagacagttttaccgattccacactgatggataaatggtacagcgatcacgatatgcatatgatgtatgtcggagagattgtcgaagtaactacccgctaatcttatcggtcctttcatttaaaaacgctgtccgcagtggccaaagaccaccacgggcagcatttttatctgcactctgtgctgattgattcgatagcaaccgaacctccgcgcacaacggaaatatgcttaaactttttctttaagatggcaatcagatcgtcatgtttctgctctgttcttctgcactcaagcataacactgccgattccgatatccaccacatccacacgcatggcctgtgcaatctgaaacacttccgtcatctgtgtctcattcagttccataatcttgacaaacatcagctcttttaaccgaagcggaacatttgtcaggtcgatcaccttgattacctcaaccatacgatttaactgctttttgatctgctcaaacgtgatatcatcactcgccacactgatcgtcatacgggaaaccgtctcatcttccgtcgtaccaaccgtcagtgactgtaaattgtaggattttccggaaaacagtccggaaaccttcgcaagtacacctacatcattttctacatacaatgcaatccagcgctttttcatttcagacattgctttcctcctattttaaaatcatttcactcatcggatttccgctctttaccatcggaagtaccagttcatcggtggcaatcataaattcaatgatcgtcggtgcatccgtatgcttctttgcctccgcaaacgctgcatcaatgtcttcttccttctctacacggattccgtatgctccatagctttctgccagtttcacgaaatccggaacatattccggacactgatcatttggtcccttgcatccacccggacaggatgggcgccggcgcagacaggtcgcactgtaacgctttccataaaacagttcttgcatctggcggaccataccaagataattattgttcagcagacagatcgtaattccggtaccctgtgttaccgccgttgccatctcctgaatattcatctgaaatccgccatctcccgtgatacacacgaccggtttctttggatttgcaatttttgctccgattgcggccggaaatccgaatcccatcgttcccagtccgccggatgtgatgagctgactctgttcatccagttccagatactgggttgcccacatctgatgctgcccgacatccgtcacataaatactgtgtggaaactgtgcattaatgtgctccatgatcatctgtggactgatcccacggtccctgcgcatggcaagcggattctctttctcccacctgtgaatctgttcctgccactttgccgtatcctttttctctgcccactctaacagcttttcaagcgccacacctgcatctgcaaccaccggcacatccacaaccacattacgcgagatggaagccgtatccacatcaatatgtacaatctgtgcatgcggtgcaaattcatttaaatctccggtaatccggtcattgaaacgggtaccgatggaaaagagcagatcacattccataactgccatattggctgcgtactttccatgcattccacagtttccgatatacagcggatgtgtggtcggcactgcgcctttgcccatgattgttgtgacaaccggaacattttctttttccataaatttcttcagcttctctcccgcatggctgatgttgacacctccgccggcaagaatcagaggtttctttgcagacttaagcattttataagctttcttcaactgtccgatatgtaccccgtgaatcggcttatatccacggatatccacatgggaagggtactctgccgatccggatgccgtctggatatcctttggaatatcaatcagtaccggtcccggtttcccggtctgggcgatataaaatgccatcttaataatctttccgaggtcttcccgtcttcgcaccgtcacaccatacttggtaatgcttctcgtcataccaacaatgtccacttcctgaaatgcatcgtttccgatcagtccaagtggcacctgtccggtgaaacaaaccagcggaatgctgtcataatgggcatctgccagtccggtaatgatattggttgctcccggtccgctcgttaccagacatacgcccacccgtccggtagacttggcatatccttccgcctcatgaatcagtccctgctcatgccgcggcaggatcaggttgatactgtcggtcttatataattcatcaaataaatccgtaacggttccgcccggatacccaaagatggtgtctaccccttcttcctccagagcctttacgaataattttcttcctgtaatatccataaaaatgatatcctcctatatcagtccaaatgtgcgaagtaaaaagatccagaacgtcagcgtaaatgccgcaaacaacgtcgtcgcaacaataacactcgccgtcagaaccccatcatttttcatactctttgccatgatgtaacagcttggcgttgttggggatgccagcataattaaaattgcaataatcttttccccggaaaatcccatataagctgctaccggtaaaaagatcagtggctggattaccagtttgattgcagctgcccagcacgtcggtttgatctttgcgatagctttgcgcccctcaaatcccgcaccgatcacaatcagtgccagaggtgttgcaagctgtgcgacagagttaatcgtcttattgacaatggtcggaaaatgaatccccagaagggaaacgataagtcccagaaaaatcgaatcaataatcggatttttcacgatattgaccaatgcctgcttaatttttcccttatcccgttttccttcctcgccctgcgcctcaaatgtcagtacaataacggaatacacattgtacagcggaaccgctcccacgatcatcagcggacccatggcagaagatccgtaaatattgttgataaatgccattcccatgacggctgcactgcttcggaacgaagactgtacaaacgcaccacggatactgtcatctttgaccgcaaatttactgatcccccagatgccccagaaacagatactgctgacaattgcacagtacaatacaaatttcagatcaaatacttttgatatttctacggaagcaatatcccgaaacagcataaacggcagtgtcaccttaaaattgaaacggtttgccacggtgacaaaatgctcatccagcataccgatctgatgcagtacccagcctataaccatcaccagaaaaataggaaatgtgacattgacgctaaagataaaatcactcattacttctgcactctttcatatttatagaaataaaattccagatcaaaatatgtctgttcttcactgtctgcggtaattttccactccggtttttcatccagattcgggaaatacgcatccgcgtcatatgcatagtcgatttttgtaatatgtgcaacatcacactcatccaaaagctgctcatatattttctgtccgccaatcacatagacgtcattggtatcatacttttccaattccctgtgcagctcttccatggaatgcacgacaatcgcatctttaacctgatacgccggattatgtgtcaacacaatattggtgcggtttttcaacggaagaccattcggaaaactctccaacgtctttcgtcccatcacgacaactttcccggttgttgtctcgcggaaaaatttctgatccatcggaatccgtaccagaagctcattattttttccaattgcccaatttttatctactgctgcaatgatattcataattttctccttcctgactgctatattgccaccggaatgtttttgatctgcggaccggtcacataatcggtcactttgatatcatccggtgtaaactgataaaaatctttaatctccggattcagccagaatttcggtgccggatgctgctggcgcgtaatcagctcttttaccagttccacatgccggtcatagatatgtgcgtccgcaatgacatgtaccagttctcccactttcatgtcacacacctgtgccagcatatgcatcagcactgcgtactggcatacattccagttatttgcagtaagcacatcctgcgaacgctgattcaaaattgcatttaaagtcagtttgtcatctccctgtttctgtgtcacattaaaggtcatactgtatgcacacggatacagattcatctcatgcagatcctgatgcacataaatattggtcagaatccggcggctgaacggattattcttcagatcataaattacccggtccacctgatccatcataccctcacggtactgatgtttctgtgccagctgataaccgtatgcctttccgatagaaccgttttcatctgcccattcatcccagacggtactgttcaaatcatggatattgttggatttgcgctgccagatccacagcatttcctccgtacatgtcttgattgccgtcttgcgcagtgtgattgccggaaactctttcgacagatcataacggttcaccacaccgaattttttgatcgtataggcacttgtaccatcctcccagtgcggtcgtaccttttcgccctcggtacttgtcccgttctccagaatatcctgacacatagttacaaatattttatctgctaaactcattgttaatcccctatctcttgtcctggacttttacttttcattataccttattctatcaaaatgtctatgagaaaatctgctgtactatcagtttatactccggcagagactggcatttccggatcagctttaaatatttctctctgtccggaaatgactttgtcagataaaaccagatttctttcaaatgaaaaacgacatctttttccgcacggaaagtatccagacatccctctaaaatttcatcatggaacgcccgcagcctggctttatctgccggtgggtttcctttgatttctccgaccagtccgggattttccagtaatcccctgccgatcatgatgcgatcaatagctgggaaagcagctgtcactttcttataatcttccacactgcatatatctccattgtaacagagcggcacatggatctgctccagagcacgggcaaatgtttccatccgcggtgttccgctgtaataatcgttctgcaggcgcggatgaataatcagttcttccagcggaaactttacatagacaccgcagagagcttcccactcatccgggtctttgattccgactctggtctttaccgataccgcaagcggacttttctccagcacttcttccagcaacatttccagttctttcggatctgccagaaatccggccccttttcttttcgagacaacggttccggacggacagccaaaattaagattgacactggtaaatcccagatcttccagctgccgaatcatcatcagaaattcatcggcacgatttccgatcagctgcggcaccagccggatctgctcattattttccgctgccagatcctgctttatttttttgctcattttttttgctgccgggataaacggtgtaaaatatttatctatatatggaaaataatgtgcataagcattgcgcacaatatatcccgtaattccctccatcggagcaagataaaataacataattttccctccatttttctattataagaattttaccggtaaaagcaaatgattttccgataagaattgacaagttttcacccaaagcctatagttacggttagaacgaacttaaaataggaggtgttcgacttggataatcacaacgagaaaaagacaaaacaaatcaaacggatactggctatcattaccattgtttttgtaatcctgatcggatattttatcgggcgtcccctggttcattttgtatcggatcccaaacaattccgtgtctgggtcaatgacaaaggaatatggggagtccttggttttattggaatgaacatcctgcaggtactccttgcggtaattcccggtggtccttttgaaattggtgccggatacgctttcggggtaatccgtggtacactgatctgtgattttgccatgacaactgcaagcgtcatcatctttctgtttgtgcgccgtttcggcatgaagtttgtggaattgtttgtaagccgtgaaaaaatagaatctgtaaaaatattaaaaagttccaggcgttcggagagcatcatttttctgctcttcctcatacccggaactcccaaagacctgttatcttatctcgtcggactgaccgacataaagctttcccactggatcattatctgtgcagttggccgtatgccggcaatctttctttctgtcttaagcggcaacgcattaaacaaagcggattacacatttgtcattctgatgtttgccgtcatgatcgccctgtccatctgcggatttttcttttaccgctcccgcaataaaacaggcagcggttccgagaacgacaaggaataaattcagtacggagcacggcagactctctgctgttctccacaactgctgcattcgtccagaaatttattaatgcagacgtgacacacatccccatctttgtccctcacacggatcacatgtgtagatacccactgatagcgatctccccgtcccttctgatacagcttgacgcagacttctttccgtccctgccccagcatctgtaacagacgttccctggagaaattgtccagaaacgcacgctggtaattcgggtgtatgttttccaccccgacatcaatcagatcatcatattttccactgctcggcatgtcatttgccagaaatccgtcatccttgatcatggtatatgtattttttgtaagatttgctgccacaatcatcggaaatacttctgacactgcctcaaacactgtcagtacctcctccatgctgattccattcagtgcttcgaactctttaaacgatcttgcactcttcatctgatgcacctcccaaacctcgttttcatttgtttttgcccctcttttacccctgcctttattataaataaaacgcgtcctttttacaatagacaaaacctgcggaatgataaaagaaaaacagccgaacccatatcctctatgtttccagctgctttttcaagagcgatagacggggctcgaacccgcggtctcgaccttggcaaggtcgcgcgttaccaactacgccactatcgcatatgcaaatatttacttttgagagcgatagacggggctcgaacccgcggtctcgaccttggcaaggtcgcgcgttaccaactacgccactatcgcatatgtaagctctctcgtgagcacagataagataataacagatacatgctcttctgtcaaccactttttgaattttttatacattttgaaaaatttataccaatgggaagtttaaaattaaacgcatgaatagatattccctgcatagaatataccaaagctggaaatggaggtaacaaatgagtgcaaaaaccagaattgtcgttcttcatatgaaaaaacttgtgtttgcaggtgtcatcacaggacttggtatcctgcttgtgatcttccttggaatcctgctcggcagttcccacaaacagtccgcagacaacgaagcggtggaaaccatgtacgttccgggtgtctatacctcttctgtcatgattgacggaaatccgttcgatgtgcaggtatctgtcgacgaagaccatatcaacgaaatcaccatggttcatctggatgaaactgtagaaaccatgtacccattggtccgtcctacgctcgatgaactggcaaaacagattatttccagccagtcccttacggatcttacatattccaaaaacaaccagtatacctgtcgtctgctcatcggtgcagtatccgaggcattggaaaaggcatcacccgatcggtgatgccccacatgcaaatatctgataagcagatcttattgtgcctctgtgtttaatccactcacgtagctggacaatgcagaagtattggtataatacgtctgtgccggcttattatcctcataataattgtatccggtataaccggcccatccaacgatggcaactaaaattgcacatccacagatgataccaatgattttttccgttttctgctttgccatctcttttttacgattggctttttctttcttatatttatctacctttgcctgactcatatttccttctctcctaaatctgttgatggttctattctacacattttcaacagaaaaagcaagtaaacggttttacatattgcgggagatatccaggcacttcatcattgcctcgatcacgctgctgcgcatgcctttttcctccagcacacgcactgcctgaatggtggttcctgccggagagcataccatatctttgagttctcccggatgttttcccgtctcaagaaccatctttgcacttccaagtaccgcctgtgctgcaaatttgtacgcctgctgtctcggcattccaccagccactgctgcatctgccatggcttcaataaacataaatacataggccggagagcttccgctgacggcagtaaccacatccatcagatgctccggaatgacttccgtctgtgaaaatccactgcagagatcccgcaccagagccatatccgcatccgtcacacgtgctcccgcacacatacccatcatgccttctttgaccatagatggggtattcggcatcgtacgaatcacttttaaatttcgtccgagcacttcatcaaaccataccagtgtctttcccggcgcgatggataccagaatctgctcttctgtaagaagatccttgatttcctctaacacttcggcataaaactgtggctttactgccacaaacaaaatgtctgcaaatgctgccacatcccggttgtccgtactgatctgcactccgaactgtgctttcttttcttccagtgttttcttcgtacgacaggaaatcatcatctcctgcggagggcattttccggattccaaaattccctgtatcatggctgttcccatatttccacagccgataaaaccgattttcttttccatgttctatctagctcctataatctccattaatttttacataatcatacgtcagatcacatccccaggctttggcagatgcctctccctgatgcagatcaatattgatataaatttcatcttcctctaagatttcttttgctttctcctcagagaaatctacaccggcagcatttctgcatacggcaatggttcccttggacgatgccagatccacatccactttgttgatatcaaactccgcatccgcataaccgattgcacataaaatacgtccccagttggcatcttccccaaacattgcacacttaaacagtggggaacggatcacactctttgcaataatgattgcggtatcctgatccggcgcgccgctacaggtacactccagcatcttcgatgctccctcaccgtccttggcaagcatcttggtcagcgtcatgagtacctgatacagcgcctgacggaacgtatcataatcctctccctctgctgtgactggcgtattttctgccatgccgtttgccagaatactgaccatatcattggtagaagtatctccatcaatgctcagacaattgtacgtcacctttacaatctcagaaagtgctttctggatcatttctgaggaaatcgcaacatcggttgtaacaaaatttaacgtggtagccatattcggatggatcatgccacttcccttcgccataccgccaaccgtacaggtcttcccgtcaagcgtaaaagaaaccgcggtctccttggcataggtatcggttgtcatgatggcatttgctgcttttccatgattctgtggagaaagtccgcgtgccagctcctgcacatgatcacggatcggttcaatcggaagcttctgtccaatgacaccggttgatgccacgatcacctcgtctgcctttattcccagctctgctgcagccagatcacacatcatctgtgccttttcttctccgtctgcattacaggtattggcattcttactgttgacaataacagccctcgccttatttccggttgctgccagatgtttctttgtcacaaggattggtgcaccctttactttattcgttgtatagacagccgctgccgtacactctttctctgaccagatcagtgccagatcatttttgttccgatccggatttaacccacagtttaatccgtttgcggaaaatcctgcagccgcacatacaccgccctcgacctgtttcattgttacattcataatttttatctccttctaagttatagtagtaaaaatcctcagcagaatttctcctgctgaggcacctttatctcattccatctgtttactttatgtacttatccagttcatgagataccgcaagcacattgtcaagtttctgttttgcctgctcggcattgtttaaattctcaactgacagatccgctacctgtacggaagaggccgtcacttcttccgttgttgcagaaagattactgatattgtctacaatctgattgtttgcatccgacagacggtttaacatgccgtcaatgcctttgatctcctgaaccagtgtattgacattctcattcattcccgaaaaactctccgatgctttcgcaatcatggaatcctgcgcattggtagcctcaatcgaacagctcaccgccgttgctgcatcctctgcatttttaaacaattcatccagaatctgtgcaatgctttctgtctcacttctggttttctctgccagctgacggatttcatcagccactacagcaaacccttttccggcttcccctgcacgggcactctcaatagaagcattgagcgccagcagattggtctgactggaaatggaaaagatggtatctgcaatactctttactgcctcggtacgctcctgtaacgctttcatggaatctgccactccggagtttgtctctgcgattaccgcggactgtttcttcagattttccatgatctccatactcttctgattcagttccccggactgctttgccacttttaccatattctcggaactttccagtgtctgctcaattgaatgctggatatcctgtgtcatggttgtctgtgtctggatattttccgccgtgctttgcgtgctggaagaaatatctttcatcgcaccattgaccacctctgtcgatccattcagatcattgacaatcttcatcacggattccgtacccttacgcacttcttccgccacaccgatcacatcgtctaaaattgcctgctgcttccgctgctcctgctgttcactgtgccgggtatcatggttgaatttctgtgccacatttgttgtaaagatcacagcaaataccagtacccccagtgccagcagatccagtacaagattggttgtcccggctacgccttccggctgctgacggatctgaccaaagacagtcagcgcattcaatacaagataaccgatgccgccgattctggaatatttcggatcaaaaaacaaaatacagccgataaaaggagccagtcccagaaaacggataaagctctccgtatatgcaaaagtcatgaaaaatgatacgagatataacccgatcagtgccagatatctcagccgctccgattccggacgccgcttccatccaatgagcaatgcacctccggagactactgcaatcacactgacaaatgccgcaaagcccaaagaacgtactccttttgctcttgatgcccagagcataaacagaataaatgcataaaaaatcagatattctgttacaaaaaaacggtttactctctgtatctgctgccctttttccgcaaagcgataatatttttcttttattttcataatcagtcctctccccttttatagttataacacacgaaagtttctgtttccatactagcacagagcaaaataaaatgcaattctgtccgctgtaataatcttattccagttcttccatgacactcttatatgctggacgaataattttgttgcatcccaccagctcctccagccggtgtgcactccatcctgcaattcttgcaatggcaaacaatggtgtatacaattccgacggaatgccaagcatttcatatacgaaaccactgtaaaaatccacattcgggctgacacccttgaaaatatgacgcttttctgcgatcagttccggagccacttcttctatcatattgtaaaggttcatgtctttctggcgtccttttgcctccgcgagatgctccacatagctgcggaacacacgctctctcggatcagacagggaatacacggcatgtcccataccatagatcaatcccttcttatcaaagacctgtccatccagcatctttccaagataggacttcacctcgtcacgatcgctccagtcatgcacattttcccggatatcattcatcatctgcataactttgatgttggcaccgccatgctttggtcctttcagggaagacattgccgcagcgatggcagaatatgtatccgtaccggcagaagtaaccacacgggtggtaaacgtactgttattaccgccgccatgctccatatgaagcatcagtgccacatcaagcacctgtgcctccagctgtgtatactgcttattcggccgcagcatacgaaggaaattctctgccgtggaaagcttcgggtccggtcggtgaatatacatactcgaatcattttcataatgattatatgcgtgatatccatatgccgcgatcatcgggaaattggcaatcagctgcatacactgacggatattgttctcaatggaagaatctgtcgtatacggatcataggccgcaagtgtcagaatacttcgtgtcatggaattcatgatatccttagaaggcgccttcataataacgtctctggtaaaattggtcggaagtgtccggctgttgccgagcacctcacagaattcatccagctgcgcctgatccggaagttctccaaacagcagcagatatgctgctttctcgaagccgaattcgttcggtccaatggatttgatcagtgtttttacattatatccgcgataccataactcaccgtcacatggcacctgttttccattttcatctttgaaggacacaatctttgaaatacgggtcagacctgtcaatacaccctttccgttgacatcgcgaagtcctctgtttaccccatactcctgaaacaatcggtccgagatcgtatcattcgtaatacacatattctgttttgatgctgcgtaatttgctaataaatcttttttctccatacttcactctccaatctgtatagtcttaattatatcgtacttggttctcaaaaaaaagcatttcataaattttttatatctttttacgctttgtatataaattttataccccataaaatttcatcagtgcatcgtaaacattcatttttccatagccccaggcggtattcggataggatacatccgggttcctttcgcacccgcggatcagaatatttccgatctgcaccgaatttaaaagcagtcttctcccacggctgtttccccactccatgatctgtgcacatgctcctgccgcaattgcagaagctgcactcgttcccgtcagtgtcacataatttccaagccttcctatcgcctgcacgcccacagccggatccacaaaatccggttttacaaccgacgcaatggtattccccctcccggaatccagatataaaataccactcttttgatccattccacccaccccaatcggaatttttgccgaagacggcacggtaagtgtcacatccggatccggacgcaaaaacaccacgtctttttctaacattccactcattggcagccagatatgaaattgtcctgtgatcgtggtactcggattaacatacagcgtccagatccctgccgccgggttttcaaaccggataaacaccagctgatccccccgcgtgcgtcccacctgtgcataatcaatttccactcttgtcccttcaaatataaattcctgttcctgatgcgaatttccgggcacattctgcgccggcataagagtgcctcccggcgaacgcaccgccaccacaaacaattccggtgcactggcccacaactcaagataaaatccccgcatccgctgttccacattcacctctaccgcaaccattgaatttccatcacttttcccgtaaaaatgatgtctggcattcgcctcatttccggttgccacaaccgcacaccggcgccatctgcccgcaatatcatcaagaagttccgaaagattgctgccaccggaatggcttccgttgtttgtcccgagaccaaggcacagaataaggggccgccccagttttctggcagtctcttcgagatattcaattgccgccataatgtcattttcctgataggcaggcatctcttgcggaatataaaaaaagtctttcagatatggttttgccggttttaactttacaaccagaagttccgcataaggagccgccccagtaaaaccagcctgcagatcttcacttccgcaggcaatacttgccagcatggttccgtgcccatcttcatccgtcactggaaccagttcccgcggatgttcctgttccagtgcctcattgatctctttttgtgtatattccgttccgtacaaaaatccctgaggggtatttttctcccccgccggaatactctgatcccagattgagcggattcttgtacttccatcggcattccggaaacagggcagttcataggaaattcccgtatcaacaaatccaataaaaataccctgtccccgaagggacagggctggctgattctgcagctgcaggataccggttgtctccagtgcaagcgtatccagcagtccgaaacattttgggataatcgaatatccgtatgtcttaatgctcagctgcggcacctcgtcccggtcaaaatattctgccacaaatttttcaccgatattttgtatacattctgcccggtcgtcagaaatctccaaagactctctggcaatcaggatatcgtaggtattgttggagcggataaatgcatcacaatttctatccataagaagctcccacacttcttttccgtaactatatgcacaaaactttcagaatagaacttattcttttacacatgccacgccatacggttccagtgtaagaattcccttgatcacctctcccgtcagaagatcaattccctctaccccggaaacaatctgcggtccggtcgtatcattcagataaaatacataccgcataccatccgcttcgcgtgtgtgacgttccacgccatatggaagtttatacatcgaaactcccgcttttttcagtgtacgcgcatacaggtgctgcatggaagcatcatccagccgggccgcgatatacatggcactgccgttttgacatgtgcgctccgttactgctgccattcctttgtaataatcctgttcataggtaccaagcacgtttgtgccatctgccacacgcagaacttccgcataatcccgtacttccccttccggcatttcggcaaaatgtacgcggttgcggtcggacggatacagtgtatcaatttcctcactgatcacgccaaagagatcctttaatccgtctcccggaaatccgcccagataattgagctggttttcatccacatatccggtcacataggttgcaatcagatgacctccctgctccacaaactgtttcatgcgctccccgacatgcggatgcagcagatacagcattggtgccacaatcacagaataaccgctataatcctcttcactggaaatcacatccacatccactccgagtgccgacagattgcggtatgctttcctgcaggtcttaatatagttacgggtggactctgccagccccttcattccatccgttgcccagaggctgtcccaatcgtataacacggctaccggtgcttttacgactgtccctgccagatctttgagtttctttaattcttccccaagatctgccacttcacgaaaaactctggtatcatccgttccgagatgatccacaaccgccccatggtactgctcaaacgatccccttcctttccgccactggaaatactgcaccgtatcggaaccgagagccactgcctgcagcgaagccagccggtgtacgcccggacgtttcattttattaaacggatgccagttgaccagccccggcgcgctctccatgagcataaacggctgctcttttttcagacaacggatcatggcatgatcaaacgcattttctgtcatcgtatctgaaaacgactcctcatcattgtgaaaccgcggataagaatcccaggacaccacgtccagcggctgctgcattttatgatagtccagtccgtcatattctttcataaaattcgttgtcaccggaatctgcggggtacgttcttttaaaatggcaatctctgccttcatgtaatccgtcatattccaggtggtaaaccgtttccactccagattcaatcccataatgctgaattctccgttgcggtacggcggttcaatctgggaaaaatcattgtaagtatgactccagaacgttgtccaccatgccttgttcagtttttcaatatcatggtcaaacttttctgccagataatcctggaaccgctttacacagtgcggacagtaacattccccgccaaattcattggaaatatgccacatcagaagtcccggatgatttccgaattcatctaccagcttattgacgatcacagaaacctttttacgataaaccggtgcactcatacagtggttgtgccgcaccccgtgatgttcacgcaccccgtaagaatccacgcgtctgcactccggatatgcctcatccagccatgccgggcgcgctccggacggtgtcgccagtatcgtataaatgccattggcatataacttatccatgatgtcatgcagccatgcgaaatgaaattccccttcccgcggctcataggttgaccaggaaaataccccaagtgttgcacaattcatcccagctttcttcatcatacggatatcttcttccagaatgtccggccggtccagccactgttccggattgtaatcccctccgtgcataattccgccgatctgcggaaataaaatctttttctccatgtttcctctccctttattttgcgttttctatattccggcttgcatgacaggtaaaatataaaatctgatactccccggaaatttttccaaacagttcattgccatgtgccatcttttcttcatccagattgacaaacggatcgtccagcaccagaaacggtttttccttcggatacatcgcatccaccagcgccagacgcatacagattcccagcagatcctgatatccagcagacagccacttggtttcccgcatctcgccctgctctttcatctgcacctcgatgttggcatccaccatccagtctttttctttatccccggttagaagcgtgtaatactttccaaacccgttctcgatcggacccaaatatctcgcggaaaactgctcctttgcattctgcaggaactctcccgtcagacgcagggtttcatataaatgctgttcttcttcctgttcctgtctgcagatggaaagctgctgttctttttcatcccggatatccagctgatcctgcagatcttcgagctgatgatggtactgctcgatggcttcccggatatcctcgctccgctcatccacatcacggatcatggaattgagttcgtccagagaatatggacatttttccaccgctgccagttctttcatattgtgttcctgttcaaacagttctctcttttttcttgcctctgcgtatgctttctgtgcgatccggtactcggttgccttcatctgtaactggctgattcctgctgcaagatcttctccgaaatccattcccgcttcttttccaaatgcaagcaaagagttctgtttccgctcaaattcctgtcttgccgcatcgctttttccggcacggctgcgcagacgctcatattcctgcagctggctgcggagttcatacaggcaggttctggcatccttttctcccggaaccatctgatactgctccagaaaatgcttggtctcctgttcgatgcgcgaagcttctttcgaagcctcttccatggttttttgaatttcttccaccggtccgcggagcttacgctcctcttccagatgctgtacccggagtgcacgcaccttttcttcttcctttgatacctgcaccttgcgcaccacaagaagcaccatacctgccactgccgcaaccaccgataccgccagaagcggaaggaaaaacttatgtacctgtggcaacagaaacgacaacacaccaccggcagcaccgatcaccagcaggataatgccgcagatcatcatcggaagacgattttttaccgtataatccggttcttcccgcttcattgccatcgcttcaaaataggacattttcgtttccagctgcgttttttcttctttgagttttgcaaaacgctcctgctctttttccatttccgttattttttcttcagaaggaatctggttttcaaacttatcaccaagttcctgcaggcggttttcttcttcctcggtcagccccagattaaacaaagtggtttttaacaccccaagcatctgtacatcctggttctgctttgcaaactcctcatcctgcggcacctgtcccggaaatacatccgcaaaagcatccagtgccgctttcttttcctgttcctcctgtttggtggccgcataggcctgcttgattccttctctgcggctctcttcactcgccacctgcaatgcttttgcatactgatcccgaatcccggccagttcttttctctgctcctgtttttcggtaagtttttcggtaatctttttgtaagacgcctctgccgcatcatagccacgcagttcttccgttaacagcgtgatcatgttcgtccgctttttcatggaacctgttgcacggtccggcgaaagtttattcatccggtcatgaatctttttctgggcagtttcaaaattattgatatcatttgtattctctacaagatttcccagcttggcattaatcgcatctgtcgagcagcattcgcagtcattttgtgcaataaatgcgctccttttaaacgatgcactgtcgagtccgaaaatttcacttccgatctcggaagagaaatcatgacattccagattggtagaaagatcatataaatgaaaaacatctgttttttctgtttttccaaatgtacggctgatccggtactcttttccctgataggaaaaatccagttctcctccatacgttcccccctgccacgggcggaataccacacgttctttatcaaacagtccggattctctcttagagtcaaacccgtaaaacatcacccgcaaaaaagcggccagtgtactttttccccatgcattcggttcgtgaaacagattgaccccgtcctgaaattccagatgcagatccgatagttttccaaaattgtcgatatgacaggaacgtaatttcatcctatatctcctccccggacaatgccaaaattccacagcggatcacttctgccttctgctcctgtgacagttcagatccaagtaccatacggataaactccccctttaacgaggcatctttttcataatcactgtagtcgacccgaagggttgtccggtctttcaccttttcaaaataaaaataatccgagaacagattctgcagatactcgcaattgatctccgcatccacttccacctcaccggtcagtacaaatttgacaaggcttcccgacggatactgcgcctgttttacagcttcttccatccgctctgccgcttctcttgtcgtcatgacattgctcacatccacttcaagcgtgtacagcgtgcgggctgccatctgaacaaactgcatctgggcacggcaggtctgctcgtccacatccagtaaaacaaatcctttcggtccacactcgtcaaatccgcgtccttccagacatccacagtaacaccaggtaccgcggttatccagcttgtcctgcatgaaggtatgtacatgtcccagcgccagataatcaatatttttatttttcagctggttcaggctgatattctctgcctgtgtgcgacatgcataatctcccgcttgtccgtgcatcatgacaatattgaaatcttcatgccccagcacaagggaattgtaaacggtcgcccggttgttctccgagagctcgattccgctgatcacaatatttccataccggtatgcagtccatgtatcggaaaacaaaagcagattgtccggtacttcctccagcttggaaaggaaattgtcactgtcatggtttcctctcagatataagaaatcaatctggggatgtgtacagatcatgtcccttacggtgttgcgcgccaatgctgatacatttcgtgtatcaaacagatctcccgatatcatgatcagacgcacccctgtcttttctgcatattcgaccatccgtgtaaacgtacggatgatttctcttttgcgctctcttgcctgctcttttgtcaggtttgctgtcatctgggaatccagatgcagatccgcacaatgaatgattttcatacatcctccttatgaattacgaacaaaacaatactgtttctatcatatcatacaatagggaaaagaaaaagacctgatgccctccggcatcagatcttttatttcggtttttctacattttatgcgtttgcttcctgttccggaagtgccgcaactccacgcatttcaatgagcggtccgccctttttctccacataatcctctgtgatcgtcacttttccgatattgtcatcctttggaatctcatacatgatatccagcatgaactcttcaataatggctcgcagtgcacgggcaccaactttcttttctttcgcctgctttgcaattgcatgcaaagcgccctccgtaaactccagatccacttcatccatcgccagaagctttttgtactgacgtacaatcgcattcttcggctctgtcagaatacgcacaagcatatcttccgtcagtgcttccagtgaaaacagaatcggcagacgtcccagaaactccggaatcattccgaatttacggacatcctccactgtcactttgcaaagaaggttttcttccttgtcgtatttatctttcagatctgccttaaagccgatggacgcctccttgtttaagcgctccttgataacctcttccagttctggaaaggcaccgccacagataaacagaatattcttcgtatctaccgtggtcatcggaaccatcgcatttttgctgcttgctccaaccggaacttcaatctctgcgccttcgagaagctttaacattccctgctgcaccgactctccgcttacatcccgctgattggcattgcgcttctttgcaatcttgtcgatctcatcaataaaaataataccgtgctctgcacgctccacatcattgtcagctgcagccagaagtttgctgactacgctttcgatatcatcaccgatatatccggcttcagtcagagaggtcgcatctgtgattgccagcggcacatccaaaagccgtgccagtgtctttaccagatacgtctttcccgatccggtcggtccgatcatgagcatattggacttttcgatttccacgccgtcattggtgtcttccatcacacgtttatagtgattgtaaacggcaacggacatcacttttttggcatgctcctgtccgacaacatactcatccagacgcgccttgatcctgtgcggtgccggaatggaatgaatatccagttccggtttcggctgctcatcctttggtttctttttctttaacttctgtttgtttggaactgcattctgcagatccgccagattgatcatactgatattcggcatttttcccatgttcatattcatgaaatcgcccatgttaaaggtgccgttgttcatggtatcaaatgttttctgcatacagtcctgacaaatgcagatatcattctggatatgtatcatctttcccgcaacactctccggtctgcggcagatgtaacagacatcttcatattcacttgtattgtttgtatcggatgtcgtggtattttctttattattctggtcttccgccatcgtataaactccttttttacatataacattgccgccgcagtaagcgacggcaaaattattatacgatattcagcctgtaaagacaagttttcccctgttttttcatttttctttaagatttaaagcagttcctttaagattttatttacgattcccggatttgccttgcctttggttgctttcatcgtctgtccgaccaaaaatccgattgctttctcttttccgttgtggtaatcctccaccgactgcggattgtctttgacaatctgctctatcgttgcgcgaagtgcatcctcatcgttatcactctttaagccatgctcttccacataacgctccggatcaatgtcctcatcaaagactttttcaaatacttccttggcaacggaattattaatcgttccggcctctgtcaattcgataatttttgccagatgctccggtgaaaaacggagatcttcggcatccatttcccggtcctttaacagacgcatcgtttctcccatgagccagttggatactttctttggtttattgcaaatcgcagaagtcgcctcaaaaagatctgccagctttttctccgatgtaagaatctgtgcatcatactccggcagaccaaactctgcaatataacgggccagtttttcatcatgaagttccggttgattgtcccggatctgctgcagccattcgtcactgacaacgatcggtaccagatccggctccgggaaataacgataatcctgtgcatcctctttggaacgcatcgcataggaatatccctgatcatcgttccagcggcgggtctcctgtacaaccttctccccggattcaatcagatcaatctggcgggctgtctcggcttcaatggcatgtgcgattgccttaaacgaaccaatatttttcatctcggtacgggtaccaaactctttggcgcccttttcacgaactgataaattgacatccgcacgcatggaaccctcctgcatcttgcagtcactggcacccaggtactggatcgtcatacgcagtttctccagatatgcaatgacttcctctgcggagcgcatatccggctcggacacgatctcgatcagcggtaccccggaacggttgtaatccaccagagataccccttcccagtcatcgtgtactaactttccagcatcctcttccatatggatttcatggataccgatggtctttttcccgccggattccgtctcgatctctacccctccgtcatggcagattggcagataaagctgggaaatctgataattctgcgggttatccggatagaaataatttttccggtcaaatttgctgtactgattgatctgacagtttgttgccagaccaactgccatggcatactctaccacctttttgtttaagaccggaagcgatcccggcataccggtacataccggacaggtgtgggtatttggtgcacttccgaatgcagtggagcaggcacagaagatttttgtcttggttgctaattctacatggacttccagtccaatgacggtttcatattcttttgacatctcttctctcctttctacgcttctgctgccggactgtgctgatacgttcttgtctgttcaaaactgtaggccgcacggatgatgtttttctccttgaaacaatccccgatcaactgcagaccgatcggaagtcctttgctgtccacaccgcacggcacggaaattcccggcagacctgccagattgaccgaaacggtatatacatctccaagatacatcttcagcggatcactcaaagattctcccagtttcggagcggtggtcggtgccgccggtccgagaatcacatcatactttgcaaatgccttgtcaaatgcctgcttgatcagggctttggtgcgcagtgctttcagataataagcatcataatatccggaacttaacacgaaagatccaagcataatacggcgctttacttccggtccgaatccttcggagcgggacttcttgtacatattgtgcagtccctcgtactcttttgtgcggtatccgtattttactccatcaaaacgtgccagattggagcttgcctctgctgctgcaatgacataataagccggaatcgcatactctacgagacttaaatcaaattcctctacgattgcgcctttttcttctaacgtctttgccgctgcaagaatggcttcctttacttccgggtccagtccctcgcccagatagtcacgcggaataccaatcttcattccctttacatcatccaccagtgccgatgtaaaatcggtttcttctcgttttaccgatgtggaatccttcttatcataagaagtaattgtctccagaattgtggcacagtcggtcacatcctttgcaatcggtccgatctgatccagagaggaaccgtatgcgatcagtccgtaacgggaaacggtaccataagttggtttgattccggtcacgccacaaaatgaacttggctgacggatagatcctccggtatccgatccgagtgcatagtaacattcctctgctgccactgccgcacagcttccaccggaagaaccgcccggtacatgtgcggtattccatggattctttgtctccccataggcagaagtctctgtggtacttcccatggcaaattcatccatgttcgtctttccgagaatgactgcgcccgctttttccagattgatcactgcttccgctgtataagttggaataaaattatataaaatcttagaactgcaggtcgttaacattccctttgtacacatattatctttgatggcaaccggaacacctgccagaggcccggtcagtgtcccgtcatcaatcattttctgtacttcttttgcgcggatcatcgccgactcttcatctacggtgacaaagctgttgatatccttttcttttgcacggatcgcgtcaagagcagctcttgttgcttcctcaacggtcacttcatgcgcttttattttctttcccagctctaccgctgtgagcgataataaattcatagctgcccctccttactctaccgtctttggaactacaaatgcgcggtcgcggcgctccggtgcgttcgcaagtgtgtcctctccaccatcgccgttttccacaacatcttcccggaacacattctgtaccggaaatacgtgggacatcggttccacattggtggtatccagttcgtttaatttatcaatataatccagcatgctctccatgtcttttttcgcagcttctttttccgcgtcagacaattccagctttgcaaggattccaacatattccattgtctcgtctgagattacgtttgccatattttgttcccttctccttaatctctaaccttaatatgcacttcacgcagctgctgctcggtgacttcgtttggtgcaccgcacatcagatcctgtgcgtttccgttcatcgggaatgcgatgacttcacggatattttcttcgttgcgtaaaagcatgatcatacggtcaactccaggagccatacctgcgtgtggcggtgctccgtactggaatgcagtgtataatgcgccgaacttgttctttaacacttctttgtcgtaacctgcaatctcaaatgctttttccatgatctgcatatcgtggttacgcacagctccggaagataattccacaccgttgcagacgatatcgtactggtaagccaggatatccagcgggtccatggtattaagtgcttctaagccgccctgtggcatggagaatggattatgggtaaatccgatcttctttgtctccggatctttctcaaacatcgggaaatcgttgacataacagaaacggtatgcattcttctcgatcagatccagcttctcaccgagttcgtttctgatcattccggcgtaatatgcagcgcgttcttccttatctgccataaagaaaattgtatcgccaacttcaagtcctgccagtgtgcggaattcttccttgcagtcatccggaataaacttatcaattggtcccttgtaagagccgtcttccaatacttccagatatcctaaaccacccatgccaagtccggttgcaaatttaaggagtttctcgtggaaacctttggacatatcggcgtgtacgcggattgcccgaaccgtttttccgatgaacggcttgaacgtacatttctggaaaaagtcggtcacatcgataatacgaagcgggttacgcagatccggcttatcggaaccaaactccagcattgcctgcttataactgataatcggatatggagccttggtcacaacgcttccttccggtgcgaacttttcaaatacagacgaaagaacttcttcaccaactgcaaatacatcttcctgtgtggcaaaactcatctcaaaatccagctgatagaactctcccggtgaacggtcggctctggcatcctcatcgcggaaacaaggtgcgatctggaaatatttatcaaatccggataccatcagaagctgcttgtactgctgtggtgcctgtggcagtgcataaaattttcccttgaattttctggatggtacgatataatctcttgcaccctctggagaagatgcgcataggatcggtgtctgtaactccagaaatcccatacttgtcattttctcacgcagataagaaatcactttagaacggaaaatgatattgtcttttactttctggtttctcagatccagataccgatatttcagacgtacatcttcgtgtaccacactcttgctggtcattacttcaaacggaagctgggaatatacttctccgagtaccgtcacttcctttgcatccagctcgatggttccggtcgggatctttggattgtaggtttcctcatctctcttttcgatcagaccttccacggtaatagcctgctctttacggattccttctaacagctttccatcgcggataacgatctgcatcactgcatacatatctcttaaatcaataaaagatactccgccatggtcacggatattttctacccagccagcgacacggatcgtctttccgatgtcctgctcgcttacctgattcagtgtgacatctctgtaaatgttactcatcttttctactcctttttctggtccggggctcctcttatgaaaaaagaaaagccccggaatactataattgtattccggggcgaataattcagattatccgcggtaccacccgcattgaaaaatgagacattctcatcttccctctcttacgcgtaacgtgcgctcacgtacgaacctacttccacattccggtttttcaaaaccatcctgcccgtgttcaatccgtctgctccggcagtgttcccataatcatctctttcaaacagcgctctcagtcggtgacgctgtattcctgtcgatgtctgatgatcagagtctccatctatgcattttctgtcgtacatccctgatgtacgttccttttgtaatctgttttatcacacaattccagtgattgcaagaaaaaatttaaaaatactcctttatgaaaattgcaaagtttaattctaccatccatttatacagtggaattctcttctgcacaagtggagtttaatctttcatatcataaatggtatgctcatgttggccttctgacagcagtagaaggagaactagcatgagcaaatatattcccggtaatcaaaaacatcttactctcgaagatcgcaaatacattgaaaaatccctaaacgctggctgttcttttaaggacattgcaagatatctttgtaaagatccaacaacaatctcaaaagaaatcaggctgcacaggctcagcgactggtatcacaaaggctgttttaacaatgcacataacttttgcgtccacagatatcattgcaaaaaagtcaatgcctgtggcaagatcattctctgcggtgtcaaatgtaccacctgtccaacctgcaaccagacatgtccggactttgtcaaagaacgatgtaaccgactcgataaagcaccttatgtgtgtaatggttgtccaaaagcaatcaatcactgcacgattgcccacaaataccgctatgatgctatttttgcagaccgcaaatacaaagaatgtctctcacagtccagggccggtataaacatgaccagacacgaactgcatcagaaagatatggtcatcacgcccctgatttttcagggacagtctccatatcagattataacgaatcatccagaactcgatatgtccgtgagaactctgtattcttaccttgataaaggaatcctgtccgcaagaaacatcgatctgaaacgtcaggtaaaattcaaaccccgcaaagtacacaagacccagatcaaaaacagatccgtttttatcagacgtatgttttctgattttcaagtccttgagcttgaccattttgctgaaatggataccgttcactcatcacaggactcaaagcgtgtcatcctgacattcttcttaacccgtgaaaaactgtttcttgcattcattatgaacagatgcaccaaaggtgccgtaaaacttgtttttaacaagttggaacaccagcttggcacatatgattttttaaccttattcaacacgattcttacggatcgcggatccgaattcggagatccggagtctctcgaaaacggcattaatggcattatgcggtcaagcatctattactgtgatccgatgagaagcggtcaaaaaggcggcatcgaacaggcacataccatgcttcgaatgattcttcctaaaaagaccagctttgaatatctcacccagtgggatttaagaactatcgtagaccacataaattcaaccccaagagaaagccttggtggtcgaacaccgtatgatgtagcacttgaaaactatggtatagacatcttaaaagcacttcagcttaggccgattccacccgatgaggtcaatctgacgcctaagctgatacgctttaaccactaacttagcataaaaatctgctgtcaggctggaacttaacaattcacattttttgaatgcggcctgtggaatttagtttcgcacagaaactatccagaggcttgtttgccatgcctgaaagtaagatgttttatggaaagttaatctaattatagcagttttataaggatttagcctcccacaattctaaaaaatcaaagaattttaaagcgtggtggaatttacccctgcactggaatttactttttcaagtcagcaaatactcctttagtgctacaagtgattccacttttttgtatataaatttctccagttcagcatccggctgtgtcagatccggcaccataaacaccttacatcctgcactgtatgcactgtgaattccatttggagaatcttccaccgcatagcattcctgtggctgcacatgaagctggctgcaggcgtacagataaacatccggcgccggtttgccatgggcgacctgccgggcagaaacaatatggtcgagatagtcatacaatcccactctcttcagcagactgctgctgcgctccacacctcctgcggtggcaatcgctgtacgcacaccttttttgcgcaaatattttaacagttcctctgctcccggttttgcctcaatcggtccctcatcaagcacctgatccgtcagttttctgcgataggtatgcactttgtcatagtcaaaatcttctccatacagctttttaaaatgttccggtgcataaggcatcccaagggaacgcacactgtatgcctcctcatcggtcatatgatatccgaaatgcgccatagcctctttccatttcgcgaaatagtatttttctgtatccaaaagggtcccgtccagatcaaaaataacggtctgtatcatgtctttttcctcctgtgtttctgttcaaaggctacccggcgaacaaaagctttcccgactctatacctcaagaaaccggttccactcctgcgtatcgccgcttccggttactttcagcgcgtaggtacggtcgttggttccgtcaatgataaacgtataaacaccgctctgtaacgtcagttcatatatggttccctccaaaagaacctgtgccacctcatcatactttgctttttccacttcctcgtccggatacgtgtgctttaaatttccatcagcatcgtattcgttgtatccttcctcaacaagcgaaatgatttctgcatctgaaatcttaaataaaagttcattggtacgcatcatccggatgtcgcggttgcaggaattttccggacagatttttacattgtccagtaccagatgaaacatgcgctctgtcagctggatgtccccaaccacagcctcgccaaattcaaaatgatttacctcgttaattgtgctgtatttgtattccatgttgttctcctgtgtttttatgattcattatctgcaatgaatcctgttatttttcttccctttttatctccacatttccttctgtgtgagaattttttcgcacataatttctccttgcagtttctgtgccactttttcatatgcgggcaccggaacctgatatctgtgcgccatgcgcaccacttcgtataccagaccatccacttccgacggtctgtgtgccatcacatccctttgcatggacgtggttgcctccggcggaagattggataacatctgctgatttacggaaataatatctttttacaaccagctccaatgatcagatatttcacccaatgtcactccttacttaccggggaatttcgatttcttttgaaatgtcccctttctgctgtaaataatacaggaatcctttgcatcctgcaaccacatcttcataggtttcatcaaaattgccggtgtaccatggatctgccacatcccgcgccccggtaaatttctgcgtgtcttcatagcccgcaaatgaaagcatcttgtatattttatcctggctgtccgtgcctcccgcgattcttgtcatgttccggatatttgcggaatccatgccgatcagataatcaaaatacagatagtcatcccttgtcatctggcgcgcccggtgcggaacaagcggaatgttttcttcgtataatttattttttgtgccgtagtgcggcgggttgccgatctcctcacggctggtcgcagcggagtcgatctcgaactggttgtcgaggtgcagctggtggaccaggtgggtgaggacgctttcggccatggtgctgcggcagatgttgccgtggcagatgaataatatcttaatcatatttctttttcctctttaattattgttctattaattttctgctcaaattttaccacccatccccaaagttttttatgcataatcagcattttcaatatattctcttaattctattttctctttatacttttcaagatccatacgatattcttcgatatattttctgtggtcaatataatcaattcccttaaggttgtccttcagcaatttaaggaaatctattttttctataataagcggaatctcacttcccgaccatgaacagaatgagggaaataaatctatcttcttgaaatcctccaatttcttgtttacttttagaaattcaagaatatattccaatttccactccggaaggatatttacaaccacgtcaataagctttttacatttttcaatttctgaattgttttctcgtaatttttcaagcagataatatttctttcgttccaatatggttgcgtcagttgtcttagcaaacagtaaaccagcaaattcatttatataaaagaatctgttatcatctataaggatcttaaaagcatattccacgtattcacaccacttatcgtcccgccatactaattcaaagactttatgttcatctccacacatattgtctttagacttaacccaatccacatattcattccaaattgtatgctgttgctcaaatatctttgcaaaaagttttccattataatcaatttcgcaactaatttctattgcactcatgtaaatactcgttaatgcactaatatcatttttaaagaaattaataatttcctcaattccatcatcatgatacatatcacctaaaaattttaccgacagtttaggattatccaatacttcctttattaccgcctctttaatttcactatctcgttcgccataacgagccacaacttgtattgtagggattataggattgtctttttccaaattattgaatacaaaggttttatagtcattgacaattttttcattgatattttcttttggcacagactcccaaataaatgacatccacacatttttcttatcaaacacattattttttataaaacaatatgtagcttcatatccaatactatcaagcaaatatcttatctggcgatatccattcagtctaagcggtgcgtttgcatcaaaatactctttaagtacctttaaatatagttcaatattgccttctatgatttcaaaaacacaatctaatcccgtacttatggaccattgctctctatcacagattgtcttttccaagaatttacaagtgcaaaataatctttggaaatcctttaaatcatatatacttatttcttttgaaatagactccttacgtaatctctcatcttcctctattgttctgccaatcaaatgctcacgaatcaacattctataaattctgaattttggattccgttcagcaaccatatagcgatcgtctagccttataccaattttctcagctacttgtttgtatcttgtaactatcttcgcatcataaaaatctggtgtattcttgtcaattacgtattcatatattgtattaaaatctgactgtagataattcttaacatcctcttcattcaatccattataatgaacttctgaaaggatgttattaatagcgttacgatactcttcgttcttacgcaaaatagctaaattcttccatatattggttcgtatatcagctaattcatcagtgtacccaagtggcatccttacaaaattgacagatctactatttctaatttcttctgtgaaagaaatttctgtttttaatgcatattcagcaatttgtaaatacagtatactattattatagtttttcccttcctctgtataacaccacaccctatctaacagacgcatttcatgattatacttatctctgtatgaatacttatcatataagagccgttcacttaatacaaaataaaaatccattatcaaatctggccttttttcaaagtacagcatcaaaagatcaactgcatcttcaaagttctctgtatacttataacctcctaatatttctattaccttagttttgatattgtgataatttttcttagagttaatgtcaaaactatgtaagtcaaaatcgacatttacgtcttgatcaatatgattcttaataatagataatgccttatccagattaacctgataaaatgattcaagatactccatatcctgttccataggtgcattgtcccaagcagcaattattgaatcttcaatatattttgtacactcttctgaattgaatatttccatcaatgtattcaatgcatatacaattttattcctgaatgcaggaaatccaacagagatcagactttctacacttacccattttttctcaaacaacacatagtacaggatataattgccgaagctctgatcagtaatttttgttatctcgtttttaaaccaatccactaattccaaagaatacaaattctcgattatatctttctcaacaattttcccaccatataaattcttcatatcacgatacaactgattttcattattttttaccggaccagctatagcaatgaaaaacaatataagaatatcttgttttgtcaacttcgcttcatcaataattcttccatagtagtttttaaaaatatcctcagcattacgtatggcctgatatccaccatctattgatctcataccagcaagaaaagcaagtcttatatttccatttgcgatcccagcaatcttattaaggtaatccgaattcactattcctaaatcagctttcaaaatatcttttatttcatcatctttaagtcgtccaacttcaataatattgggtaatatgtactgcgatacagcatctattactctctccttggcataatctcttactgaaataagtacccttacatcaaaatctgtggataatgtcaaaagagtgccaagcacattctctaagcttgcaaccatattagcatcatcaaagaaaatcaaatatcttcccggatcagaaatataatactttatgtcctcatataaaagatttccattacttttaatgcagaaaacttttgtctgtccatcattctgttttctacacgcttctaaagccaatcttgtttttccaattcctgatggtcctgtcaatacagtcactctattattaagtatactagtacatatctccgtaatctctggctttctgtggaaaaaatcgcaattaataggagcatttataccatttgcatcatatgctttaacaaaatcctctacctcaaaaaattgatttgtatcaattgctatacccaactcatcttttgcaatatgtggataaagtaatgccagatcatgagaaagtgtatctattccaataagttcaatttctacaccatcaatagtttccataatactattaaattgttctatatgaatatttgtagaacaatgaccacaaattattttttttattttatccttaggtagtaataattttgttgtatcaaaacatgataaaatatcagcacgtattttctctgctgactgtgaactcacagttccataatttattaagatatactttccatcatcagctaaaacataggaatccggcgtgccttttgttggtttattggtaccagtttgaactcctaaagtttgaatattattaaatttatattttttataaagatatgcatcaaacaatttttgaaaggccccaccctccaattgcatgattgcattttgaatagaatttacattattcaactgagtctctccttagtctttccacaataatgcagtcaatattacatcatttcataatttttgttactacgctacctgcttatatctcataaacacatactcaaatatcagcttgcgatactcaaagattgcgctatctgaataactctccggcagttcttcccacaaaatcttgccgatcaggttatcgacctcagccttagtctcctgcttgtctgtccaatgatcaagttctgatatttttgtcttaatcttatccaacaaatctacagcaaccttcttgattttcttgatgtcctctttggacagattttcgtcaaaaagcatatcatacatagaaagttcttcatcactaccgaatccttcacgaacataccgctgttcctcttcattcatggaatttgccagatccatcagttccataaatgtcttttcaatattgaccctatcctgctccgaattatattcctcaataatctgctgataccgtatgtaataatccactctgcgaggattctcccttatcatggcatccagcctgacttgaatcaattcatccaaatccatgaatgccagatttttctttttaactttggcaaactctctccgcaataaatcaaagtcaattttactgatatcaaaacgttttgcaaatccacgatcattcgctgctctttcaatcatgatataatcacccagaattccgttaatctgcaccattaaatctgtattatcaacatgcttcttctttttctttaattcatcaacaatggcaattatggcatcttttctttcacggtctgccttggaaatatcatcacgatccagatatttcatcatgcggttaagttcattgccgtatgtcataaactgcttctttgattccctagagtcggatactgcattagccgctgtcagtagtaaggaaatctttgcaaaatcctttgcatatacaagatcatccaaatcgaaatctttggaatccagaaattcagcagccgctgtaattgtctcaagcactctttctatcagttcacccttgtcaatcgtcgggtcagtacttccaccacctacattagcggtataatcagcaagtgcctttcgcaaagcttttacaatacctatatagtcaataataagaccattactcttgccttctgccacgcggtttgcccgggcaatggtctgcataagagtatgtgccttgagtggcttgtccagatacagacatgacaaacacttcacatcaaaaccggtaagccacattgcgcagacaaatactactcttagcggattgtctttgtccttgaattccttatccagctcacgcttttccatcttttcacgatgatatttgatatccaaattccactttttgaaggtttgaatttcattctgttcctgcgagataacaactgccatctccgtttctttcatccagttcagttttctctcaagttcctggacttcctgctgtgatgcggtctgtatctgtttttctaaagttttgatatcgtcctgccaatatttctgcacaaagtcatacatacgcacgcaggtaactttattcaagcagacaaacatagccttaccactagtccacaaatcagagtaatgtgaaacaaaatctctggccacagacttaagtctcggttcagcagtaagcaaatgaatttccttttcaaattcatgctctaacttttcttcctgctctggatcaagatctgcagcttcaatggcatcaagaattttgtccgtaatatccggattattgatatccagaatcttttctcctcgattttcataatatagagggacagttgccttatcttctacagcacgcttaaagtcataaatggaaatatatccaccaaaggttcgctccgtaatattgtcattcgaaagaagcggtgttccggtaaatccgattcttgaagcagttggcagcaattccaccatattgtcagcaaaaactccatactgactcctatgagcttcatcagacataataataatgtcgtgatccggaatgattggctcatccaccttcttattaaatttctgtatcagagtaaagataaagctcggatttcccttcaacttattaattagatcctcaccgcttgttgctataaacttggatgcctttgtttttcccaatagaccacagttttcaaaggtatctgaaatctgggtattcagttcttcacgatccgtaagcacaacaatagtaggagatcctgcaaactttctgcgaatcttctgtgacagaaaaaccatagaataactcttaccggagccttgtgtatgccaaaacacaccaagcttaccattattcagcttacgtgcctcataagccttgactgcttcgtttactccaagatactgatgatttcttgcaaggattttgactgttttacctccggagtgatcaaaaagaataaagttctccagaagatccaggaagttctctttcttacagattccacgcagcattgtttctagggctacactgccctgctcctgttcggatagtctcttccactcatggaaaaattcatacttactgcccaaggtagcaaccttagcttccacaccattggataacatcagaaatgcattataataaaataattgtggaatggtatccagataatctgtgtagttgtctgtatacgcattctgaacatccacagagttctttttcaattcaataaaaagaaggggaatgccatttacaaaacctacaatatctgttctacgacgatagagatccccatgaattttcatttctttcacagccagaaaatgattcctctccatatcattcggatgctggaaatcaataattattgctcgcttttcttcagtctgaccatttggcttcttctctgtaaccggaattccatctcgaatatatgcatacttttcttcattgatctgcatcagagaagcagatgaaagatgcttctcaaaggtattctgagcttctgtaacctgagcatctgtaatccacggattaagcgtacgaagagccttctgaaaataacgaactaaaagaatgtccttgtaggaacttcttccaaatgttccattttctccaagaacttcctgattataagcaagttctacctgccaccccagttcatcaacaagcagatgtcctgcgctctcttgtactaatatgttctctgagtaatcgtagctcatccgattgtcctccctttcatttttcgttatacttcaagttctcccgtcataagttttggaagcagtctgtctctagcctgttcagcctctttaatctgcctttctaatatagttttcatttcaaatattggtgatgttattctttcaaattgttccaacaccgtatcggtaggatgaagtatatctattccctcaaggatttttactgtcatgctaggaacagccgctccaatgttaaacgaatacatatctagtccttttagaaatagatatgtatattttgctacattttccagcttggggattgagaaaaacatagtatctatcgtccaaaaatcgccggaaaccaacagaatattatttagtgacccctttcttggaataagcactgactctccagaatataaaatcggcttaacatatcgcatcactccaccggaaccatatactggaatattgccatcagccaatgccttatgatcttttccatactttacttccaggaaatctgtaaccttagctttgctccatccttccggcactccatccacaattttgcaattctcatatcctggaaatctcaaatcagcaaaccattccttatataaccgctgtgctgcctcttcaaggattttaattcgtttctgattgttttctatgagatcgtcaaaagttccaagaatttctacaattttgttttgaatcttgatatccggagctggaaactttatcatctccaatttttgccatgatagattatcttgagctgtcccttgcgaaatttgtttaatatctctttgaagcatatcaaatgcatacttaataaacttagcattcgatactccttcaaatggaacaaaccccattatgctatctggaaaacatgcatctatacctaaaattgcagtatccgcaatatttgctgcaatagtaatacataatgttccagctttccataatctactctgttctagccctttttcattgtaagtctctgtataatccgtaagatagaaattggctgcttttacatcagcagtttgaacaaatgggtattttccaccaaacaaagaattatcatttctgggacgatgtcgagatctcccccttgatacagtacctaattcatttaaaatcttgtaatcccaactcatagccccatctccttcatattctttgagatggtatccatcagattattggattcagcctgcaatgataataattcccgatggatttcaagcattctatcttcaaaatcaacaccatcatcttcaaccggagctactcctacataagcaccgggagtaagagaccaccctttttcttcgatttctgtcaaacttgccactttgcaaagtcctaggatatctttatattctccttcgccaaacttctcatatagccagacggcttccttagccacaataatttcatcattctttgcagctatcatttcatcatatttagcctgaattcgttttttatcctttctatcagcctgttctacttccagctttgctttcttctgcaaatcctttaattcattctttaaaagctgcaaaacttcctcaaaagaaatcacctgtcccaaaatttttctgtattcctgcaataaggctgtatatttgtccatttctccacgatacagccatactatggcattcagattctttaactgccactccgtccactcatttagggtacgatctactacagtataataatttcgtgcatcaataaataagactttatccttcagattctctgcctttcccttatcaaaaaaccacagtgaacaaggcaaactctttgtgtaaaagaaattattacctacagagatcatgacatccacatgacctgttttaattaacttttcacgaatatccttatcgctcccctgactgtcagttgcagaggaagccataacaaatcctgcacggcctgtttcattcaagtatgcatagaaataagaaatccaaagatagtttgcatttccgatttccttatttttgttttcctttggcataccaaaaggcagtcttccggcattggcagctgtttctgtttttaccttatccacattaaaaggtggatttgccataacatagttacacttaccctccagatgatgggcatcatggtagaagctgtttgcttcatcaccagatttaattacaccggtaagtccatgaaccgccatattcataaggcacagctgtgcattgtattccaccttctcctgaccataaaaagtcatgctcttgttggcctgcagtccggtttcatttacaaaatcaccggtctgcacaaacataccgccggatccacaggcaggatccaacaaaactccgcttttcggctccagtatgtttacaatcatttttaccaatgactttggggtaaagaatacaccatcgtcagacgcaatatttttggcaaatttattcagaaagtactcataaatacgtccaattacatctccccccacttcatccaaagcgttgttattaaagattcttagtaactcacccagaagctcatccgagaaatcggtgtagcttttaggaaggacacctgtcaactggtcactctgctgctccaccagctccatggcattatttaccacttcgcccaaacttcccatggtctgtcctgatacatttaatagtcccaaggaagcaacattctccggaagatttaccagataatcaaactgcgccatttcaggaaggaacaatgcactcttagccgtaaagtcacttgcctccaccggcatcttacggccatttcttaccggcctgtcctttaatatttcttcctcaaccattttatatctgctgtatgcatatcttaagaacagcagtcccaatacgggcatacagtactgatttgatgtaagctttgatcccgcacgcaggagatccgcagactcccacaaatctgcttctagcttcttaatactcgcattatccatttatcattatcctccggaattaattacttttattcagttccagctttctgaccttacgcgggtctatcggtttttctgttccaactgggatgaaccacattctacctttctgaatagcgccttcaattctgccttccttgcaatatatagccacccatctttgagatacattccacttttctgcgcattccgccgaagttaaatattccatgtattttcctccaaaaatatgtaaaacttaattaaaataaaacttttattagcttattgagctaactcctttctaataatcggaagagttctctgttcgatttcatcagtagtaaaactttcaataacactcttcattgtttcagcactctagaatattttgagtttttcctttgccctcgttattgcagtataaaaaatagaatgcgttattttctctgcattgcttgaaggaattacaatcttaactgatttatactccaatccctgagctttgtgtattgaaattgcataagcaagctgaaatggaataactgtcttcactttttcttcctctgacagatcatcatcccaagcaacaacttctaatcttataattgtccctttttctgttgtatccacataatcgaacgtttcctcctcacactgacattctgtaagaaacgcttttacttctatctcaaatattatgctttttttgcatatgatatattgataatagtacctttcaaattgttatacagtaaagtagaacgccttgtatttgtgaagataatcctatccccaattttataactccattcctcccaagaaaatgctttgctatttgtatttgcattctgaaaatactgattcatattgttcaatccaaatttaccatcataatttaagcatagaacaacttcgtcttcatctaaatgaaatatattttctcctaagttttcagaaaatggaccttccatagacaacatttccgttactatagtagatttttctcgaaccgccttccataaacctttcaattcttctttctcagtccgccacgtactagaaagttcaatgcttgccccttttgccttaacaatgtcttttgcataaaaaaaccaatttccaaaatcgatagattcaatttggtatatatcccctgacataacaattaatgcatcattacttattttcccgaggagtaattccattgttctattatctatagtgctacactcatctataaaaacaatatcatggattacagctgaattgcttcttgttatactatctattatctcaaaatcacaattgtcaatgtttttatccagacttcttatgacgttctgtagcgctgtatgagtcttggtaaggtacaactttctagcattgccaaacattcttgatatataatttattaatgtcgttttccctgtaccagcagctccataaatcagcattatattagaattaacaaaaaggtgttttaatgcaatttttttatcaatatcatcaaactttataccacaatttttaatgaacctctcattttcttcctgacgatctaaacttacattatgtgttaattgtaataatcgtttgagtatatttatcgttgtatcataatacgaagcaatagtcactaatccttccttttcgataataaaatatcctttatctctttcccaatcatctaagctggtattataattttcaataacagcatcgcttccaatttctgactttttaaataataattctcccgtttcactaattagattatcaatagtcatatatggctgtactaatgacaccacctttgaatcatccaataattcgataatgctttccttatcttttttacttgtctttgtgccaacaaggttcgcaatcattggattcttttcaaatggataacatctgctgcttacaaaaagtttttcagaaatccgttttggataaaatttatttggcaataaatcttctaatatttcatctctcatatgtagcatcgcatatccaattgtatttttacctactttacaagatgattttgaatactctcttctgatttgtatcaaaacatcaccaaaatcatgcgtgtttgttgtaccaaacaccctattatatatttgcgaaaaccgctctttcctcatgttaatcaattcaaacaaattcatccccgtctctgttaagaattccattaaattaacatactcctggtagttacgattaatttttgtatgtttcatcaacatctttgataatttatttaagcaggttggatcaatggctactttccaatcgttaagtactttaatattatttctaatcccccataattctagttcagtttctgtatatgctatctgaattgaataatatgtagtaatggtcattttactgtaaacagttaccctattgtatttggtagaatatactccagctaattgaagagtgatctcataatatctttctccattcacaaaaaaaggggtgattttatgcacataatatcttgatactcttacatttctttttgttaaatcaatattttcaatctgttttgcaactttttcgtagtattctgaatccaccgtatctaaatccaaaggaaatttttcaagattctctaagatgcttttattataattttctctcataaatctacggatttcccaaagataattataatatttgagcatcagtctctctgcctgtccttcttttggaatacggcgattaatatattttaaccctcttaagaaattacaaagatatcttgtatcaactcgaagctgtgatacttcccacgctaatttttcactaacattggtatacccattcttatacgcattaagaataagtgttgcataacataaatcatttaaatctcttacaattcttcttgatacttcgtctctatattgtggactatcatgtaaatcctcaataaaacaagaaatttcattgcattgatattcaataatatttaatgcatcttcttgttccaaatcgtcagaatttaacttattcaaaaaaaggtgtgtatcaataataccatttaacttttcgcaaaataattcgatgctttcatctgtattctttatttcatcctctggagaaaatttaattatcttactctctttttcaaaatcaatatcactcaaaaaagatttcgacatagccttccaaaatatacgttgtccctctctaatgtccggattcaaaacaacaaataaaatccctggatctgccgttacttcctttgctataaatgcagggaacgataaactttttaggcaataggataccactccattcttttcgctaaaattgtgagttcctttaatttgcacaatgaaattttgtttaggacttttagatatatctggattagatacatattcaaaaaatccatcatgatttggccacttatcatcactcgaaaaagatgtgcaaattcttcctcccggattcaaaacactttccaaaaaacttacagcagatctatcttctgctgaatgaaccgtatgtgtagctatatgtctttcaatgtgctccttctgtttcatgtaaaaaatgcctcatttcataagttcaaaattatacaaacactacaatttcaatgcataatccgtgttaataagaatcatataaattatattctattgagcgaatactttcaaccaatttcttctcagaagcgaatactttttagcttataaagccacaaatactcatcaattgtgagcatatcataaaagtacgatcagatattttattttaagaactaaagaattaaaaaatcaagacacaggcatcttttttctaaacacttaaattggggtaatcaaagtttagtgggggcattggtcctatgtcaagatttagtacaagttaaaatgagaaacttttcccattttaacccgccagaagctcagcctcagtgtgtgttctttcatacaatcgttcgaattcatttggtgacatatagttacaatggctatgaattcgtttcgtattgtagaaagcttccagatattcaaaaatcaactggtatgcctgcttatagtcgcgaattttaaagcgattgagccattcacgtttgataatagaatgaaaggattcaatgcatgcattatcccacggaaaagctttcttcgaataactgcgctgcatattttcggttgcttttttatattcctttgcaacatattggctgccacgatccgaatggataattaatggttgatcaatatttcggcgagctttggctttgtttatagtatcaatcacgcaggatacttccagtgtttctgaaagtgtccaggctatgatttttctggaaaataaatccataatactggtcagatagacaaatccgtctattgtccagatgtaggtgatatccgaacaccagacagcattcgggcggtcaggattaaactgttcatcaaggatattttgtaattctgtgctgaaatcagaatcttttgtggtgatggtccatggtttgctccactgagcacggattcccatttggcgcatatatgtaccaacggttctttccgaaatgacttcaccggtttttcgcagttctacagtgattttcggagcaccgtagttctgcttggaatcatcataaatatcctgtatttttgcttttacagctttacgacgtttttctgtatcagaaggtacgtggtggagccatgcaagatatcctgagcgagagacacctaaaaatttcaacattccggagacggaaacccggcgtccagcctttttggcagcttccgtcttctcagacacttcaagataaatggcttccgtcattttcccagaatgttgattgctttttttaacacatcaagtgcatcttttgcatcacgtaattcacgtctgagacgggcaatttccttctgctcatcagatgcataattaccagaaccacgaacaggaatatcacctgattcccggaagtctttcagccattttgttaatgtgctgtatccgatgccaagattttctgcacatccacgtactccgagatctttgtgatcctgatagtactggactgcatcaagtttaaattgtttgtcatgttgctttgccatatgagatcctccttcagcatgcctctattgtatcatgcttatgtgtatttggaatttctcattttggcttgtactatttatattctagcaccacatcctttagtagggtctataagtagggagaatccgtaggggcatttagtagggtctccacacatattaaaacagggcaggaaatctctcgatttcttgcccttcttcgtctcttttcgtatgataattctgcaacgaaattcttttgaaaggagacatatgaatagtatcacagaattattaaacttggaagatgccgacatcttcatttccaacatctcgattaatggcacaaagaaaatcttaactcttgaaactaaaccaattcgccatttctgtcctgtttgtggctttaagatgtattcacgcggcatcaaagtccggaccatcaaccatcccgtgcttcaggatggttatgagctagttttaaaactaaagcaacgccgttggcgctgtacaaacacaccttgttcttacacaatcaatgaatcttttaactttgtagataaacgaaaacgcaatacaaatgcgactgatatgctgattattcatgcatttcgcgacttatccgtctctgcatccagcattgcttccaaatacaaagtttctgacacctatgttctagccacttttgaccgctatgtaaaaatggatcggcttcctctctctgacatcatttcagtagatgaggtctgtctcgatcttgatccgaactgtcgctacgcgttggtcattcaggacttttataccggtaatccaattgatttattgagcagccgtagaacaaatgacaccgaaccttattttatgtccatcccactcgaagagcgctcacaggtaaagtatctaatttccgatatgtataatccccacatcagctgggttaaccgatattttccaaccgctgtttctgtcatagattcttttcacgtaattcaatggatcactcataaactagatctttacatacgtgagctcatcaaaaattttaagaaacgtgatcgagatgcatatacggccaacggcggcattatcgatgaacacatctttattccagcatccagagaagtctacctactgcaaaaatatcgatggctgatcctcgctaatcactcctctattacttatcattcggatttaagaatggatacactccttcactgtctgatgaacacttatgattatgaagattctctttttatgattaatataaacttgatatagaaaatccgattatccgcataaatacagcatttaagggctgttcatcacttgaaaaaataagtgttttaccacgaatttaccataattgaatatgagtcttgatatgacgaaatataaagggagattgcacgtataataaaaccgcgtatctccctttaacaaactatctaaagttttctacatttataactctggaaaaacaatcgcacaaattcatgttgtgagtgaccatgattatagtaatgcccttttcatttaattctttcaaaagtttcatcactatcaattcgttctctttatcaagtccagaagttggttcatcagctaatataatctgacttccttgcaaaatcaatttaataattgcaattcgctgttgctctccaccgcttaactgatatacttttttgttaagcatgtcacttagctcaaattgctttaaatacttattgattagtttcagtttttcttctttttttacttttttatattcaagagctaattttaaattccacaacacgctttcatcttctattagtccataattttgaaatagatagcctattgtatatcttctcaaaatcatagcatttttaccgttcatggacaaatttttatgactatcaatagtgattgttccctcggatatatcagtaatcaatcctattatatttaaaagtgtcgttttacctgccccgcttttccctacaagccccacaaattcgcctttttctatttctaaagataaattttcaaatagaacctgatttttcccatattcttttttgacgttctttaatgtaatcaatgacatacttatgcccccttttcaatctcatataaagcgtttgagatataaattctataaagcaattcgcagaatatgtagtcaataagtataatcgcaaaaaggcaagcaaaataataatttatagcagttaatacgcctgatataattatttcgattccccaaaaaatataccgatttttcagtgtcctaaaatgagagaatcctaaaatctcttttgccgcatatctctttcgatttacaaaaatgtccacataatttgaaatatacaaaataaacagtaaagacactataaagacaatcgtaaacatagtgagtgttttaagaacgaatgtcacattttcaagttgcattaaataaggtgtaagtaatgttccagctgtaactaattgctctaaatcatattctgataacaaagaagaaaaatcttctcttgactccatttgaaaaaataaacaccttgtatttaaagaatccaaatagtaaagtcctgcaaaattgcccgtatcaacaatgataacaggattagccatatccgaaaaaccattttctgtattgacttttatcgtagaatcatcgtctatataaacaacattaaatttatcaatagttttttcttctcccggtattccataaaattgattgtaattcatcaatcggaaatattcttgcttaatatattcgctaatagaattttcatcattcttatatttatgtggaactaatactgttggttcactaaatatatcttctcccaatggttttccactgagctggatatttgaaaattcattcagataatttctatttgcaataacaagctgttgttcataataggggcgtgatgtctgcaaaccaccgtctgtcctaaaatcacatagtagtgaatggttatgattatacatctctaatgtttgttcagaatatttttctaatatgtctgtgtttgctaacgcataatcatactccgatgaattaaaaccattagcggtataatatccgtccagatacttataatctaaaacagcttgttggctttgtctaaatgagttcccctgattcagcaatgaaataatagtgatagcgattattaccgaaaaaattatttttatagcctgaactacaatatttgtgccgctatttaaagtcttattttttatcattgcctctaaagaaacaaacttaattaaaatacttgtaattaaaacacaaagtatatttatagctaaaacaccaataaagaacagtacacttgttgctaaataagaaaaatcatatctgtttgttaatgcgtaatataaatttagcaagaacagtaatactaaacatattacagcaaaatattttattacactggtaatttgctcctttaaaatatgtatagtagaaaagcccatgctttttttaatacctatttttttcaaactataagacgtataaatacagtatatgatttgaagtacaataaataagattacaaaattcagaagattcaattctaataccatactatacggaatagcgtcattttcaaagttatttattgcgacggacagttgagaagctatctctttaattgcgttagctggtaaatctgtatagaatacaccaacactatctaaaaaatcttccttttgcaattcatgatattgaaacaaaatagaggaagatataggctgtttttgtgtaaactcatttaatggatagcaatataaatcataaacagatttatctgtggaagtgagcgtattgttaatgagttctaatttattttgagaatattcttctgtaaatattgtataaaatttgtcgagaatttctggcgatgtttcttctaaaacatacccttttaaattctcagtagcaatgttattcttttcataaatgttgtaaatagaagtattaaaaatatatgcaaagagtatgacttcaaggaaaataaaaatctttaaaaattttttcataacatacgcccctttctttgaagaaatgtataaaatagggcgggacaaatagccccgccctaggtgtttgaactattttacttaatatggataataatcataataagatgtttcgttcgcccaccaaactctctttgcatctttgtaagcgtagtttgacttgaatccactggtatatgtatctccgccgacctttacagttgcctttaccatgtagttgcgactaatacctgctttacgcccaatttcggaatatacaatggtgtctgtttgccctccattgtagtacaaatctccacccgctacatcaatagcccacgctgtaagtggagcgccgacaaccataactgctgctacaagaccaactactttcgttctcaacttctttgctctcattcgataaacctcctttctcttttttactttttgatagttttatgtcacgtactgtttttactaacctcaacataacatatatttcattaaatgtcaagttatttttgtttctattttatatatgacctctttgttgctatcatattttgtgcataatgcacaaaatcaaagtgccaatattagtgctttccacgattgtacttttacaatgaaaagacgaagtacctgtgataaattcattgctctaaaattattagagaaactatacaatatagctatccttttttctcttgtctgccataaacagaaaagaaaaagccctgtcaagagcctgccacttctttagaagtggtgcttgcactcttgatctgggctttttgtttgctgtatctttttgcaagaggaaaaaggctactcgtccccgttgtcaaaatggctgtcctttaagacttcccgcaacagctccatatcttcttttgagttgggatttatcctctttacaacctgataaggtgtaccgtacttgtgtccgtctgtgctttccccgaacatatccatgctgtataaatcatcataacggtctaatactttctgaaatttcaagtgctggataaatgttttgatagggtaaaggtcggacgcttgtatgtcctctcccttgatatagtctgtgatgtatttccgcaactgctccaactcatactctagccattcttcttcactgtcaaagaagttatcatagtgtccgtgtttcagttctgcatttaggcgttcttccgtccgtaaaaacttgcatacctctttttccgcctgttggacaaacttccattctcccgacaacaattcattcggtgttacttccagtacgtccattatcttttccagcgtgtcaaaggtgggatagtttacccctcgttcaatcttagaaaggctctgcatattgataccgatggcgtccgcaagctcctgctgtttcattttcctgtgttttcttatggtctgtatgttctcccctaaaaaatttattttctttgtgtcatgctccataacttcttatatcttttcctttcccggctttttcgttcctttataagcctatcatacttattatagccgaaaaagtcaagaaaaagttcttgacaagtaattctaacggcgttattatcatggaggatatagtgattaagcacaatgaggtcaatcacacgcttgagtaggcatagaaaagagttattttcgctttgatagcatgaataggcatggactatccgaccgaaaacggtgtttcttcctgtgcctgccccgtttagccacgagcctcccaaaggctcgtgagcgttaagaacggggctggtgcaggaagaaaaggaacgccgtaggcgttccgtacagggcgtatatgtaacaccgccctgcgcatacatgtcatagtacctagaaactgtgataaataaaggacaaaacacgatttttaccccgcaaaaaaacggggagtacgaaaggagtaatgcactatcgcaacacatgaaaatttatccgtcaagattgattacatcagcattgtctttgatacggcaacggcagaagatgtgatacggcacattttatgcttgccgaccgatatttttaatgtctatcctgcaacggtcaaatttaagacgtatcaggcgcgttgggaaatcggagatatttatgtatcgggcgacgcaaaaaagacagaggacaacccacaagggctgggctgttatctcgtgatgacaggcagggggtgtgatgatattttccgtatcctcgataacaacggcttgacctttggggatatgttcggacgctgtgaaaggagatatggggctggaaactaccatttcacaaggctggacgttgccattgacgacaggaacgaaacgccgttctttaccatagagcagataaagaagaaatgtgaaaaagaggaatttatcgccaacagtgagggctaccattttgacgagagcaagtttgatgattttgacaccgcaaagaccgtctatatcggggctggaaaatcggggctttcctaccgcttttatgacaaggacaaggaagtgtgcggcaaatacaacaggacgcttgatgaagtcgggagttggaaacggacggaaatgcaactgcgtgatgaaaaggctcatgcctttgctatggcatttcaggcaagaccgctggagattggggaactggctttcggactgctggcggacaacctgcgttttgtcgtagcaaacaggaatgagagcaacaagagcaggtggaaaacgtgccgtttctggcaacgctttttaggggctgtggaacttttaaaactccatgtacccacaccgcataattcccttgaagaaacgcaacagtggcttacagagggtggtgtcatatccgctgtcaaaggcttttacttcctcgaatcccatgacgctttaggtgggctggaacgtgtcggggatatggtagataaggcaaggtacagcacttccctttccagcaagctgaccgcccatttacagcggatagacaggacagaattgataccctacgtccagtatgacacaaagaacaggtaggggggtggcatgatgaacgaaaagattgatattcctgtatgggaaaaatacacccttaccattgaggaagcgtcaagatacttcacaatcggacagaacaagctacgccgattggtagaagaaaaccgacacggcgactggtatgtgatgaacggcaaccgtatcttgattaagaaaaaacagtttgagaaatttatggataaaacagacgcaatctaatgcaaaagagccttgtatgtgatattatttcagtaagtcatatcaaggctctttcttacgaaaggagcagataagaaatgtcggaaaaaagacgggacagtaaaggtcgcctcttaaagacaggagagagccagcgagcagacggaagatacttatacaaatatgtggacaaggcaggaaagacaaggtatgcctattcatggaaacttgtgccgacagacctcgtacctaaaggcaagagggacgggaaatccctaagggaattagaaacggagatacaaagggatttacaggacggtatcgacacaacaggcggaaaaatgacgctgtgccagctatacgccaaacagaacgcccagagagccaacgtaaaggaaagcacaagacagggcaggaaaaagctcatgcggacattagagggcgatatactgggggctaggagcattgacagcatacgcctttcagacgctaaggaatgggcgttacgcatgaaagacaagggctatgcttatcagaccataagcaattataaacgctcgttaaatgcgtcattccgcattgccatagcggacgacctcgtgaggaagaacccctttgatttcaagctgaatgaggtcatagaggacgacaggacaccacggcaggcattgaccgaggaacaggaagaaaggctcttgtcctttgccagcagggacagggtatataaaaagtattatgacgcaatcgtaatactgttaaagacagggcttcgtatctcggaactgtgcggactgacaaggcaggatatagactttgaaaacggcgttatccatgtagaccaccagctattatccagcaaggaaacgggctattatatcgaaacaccaaagacaaaaagcggtgtgcgtgatgttcccatgagtgaggaagtgaaacaggcatttgagcgtgtcatggcaaacaaggcaaaggcagagccgacagagatagacgggtacagtggtttcctctttctgaacgggaaaggctttcctatgacgaatgcctattatacttctactttcgctaatctgagaaagaaatataacaagagccatgaggacagcttaccaaagataacgccccatatcctgcgtcatacgttctgtaccagacttgcgaacaggaacatgaaccctaagagtttacagtatatcatgggacacgcaaacatcagtatcacgctgaacctgtacgcccatgcgtccatagagaacgtcaaggcagaattaagaagcatgatagcttaaagttttaccacgatatttaccacgattgaccgtgagaaaacgtgatgaaacgtagctgtttggaagtatcagccgaaaagagaaatgcccgtaaagctgataaaataaggctttgcggacatttaagaagatatgaaaagataatcaaaaatttatattaagtttgatccaaacttaagggaacttcgtgatttaaaggaactttatgtccaattcaatactcgaaatgctgggaagccaatggatgccagaattgaactcgacaaactgatcaaccactatcttcattgcggcaattcaattttcgttgattttgccaatcttctgattcgaaaccatgcttatatcatcaactcatttgtaatggttgaaaaatacggggctggcaaaagatatagcagcagactttctaatggacctattgaatccttaaatcgaaaagttaaagacttgaaaagactcggacgtggctatcgaaactttgagcattttcgaacccgattcctatatgcgaccagggacacccctgttataaatggaataaacgattacaatcccgtcacttattttgatatggaagattaaaaaatatttcgttgcaaaacagatcaggcaggtcgaaagacctgcctgtgttatctattcatgattctatttaagaagcccctacggaatgcccctaaaaaactcatagatttttagttgtcgtccccattaattgcccctaaaaaacttcgggaaaccccactaaactttggagaccccataaaaatcggagatgaaaaatacaagtataccgccgtccccacagccgtatcgcttcaaatcatctccgctctctgattcttattcatttgtctgattctgtctggacttttcgttccattgatggaatcattatagtatatgtgcataaaaaagcaatgttttactgagaatttttatatatttttattgtgcagtttcttttatgatacgttttctctgttttaccacttttttgtttattgaatacttttcagccagcatacgacatcctcacgattcaatctgcttttgcattcaaatttatcactttccagttcgacattttctattaattctttatgcgttctctttcgccatctttctccagttgatgtatccgtaagtggaattgaataagtatgctgtccacataacaagcagtgtaacagaaccttctccaccattcataagtgccattacccataaaactacggataccatattaacaataacccacattacccactgctcggaatatcttgcaagcattaagatggttgcgatcacgctcaatattgtagaagttgcatctataagagcaaattctccatcgagcagttttaaaataaagctgtatccggcaactgcagcgatggaaccaacaattaagattacccagccttttgcagtcagatttcttgcctttacttccccgtttccgtctgccatgtttttcttccagctgatgataccgataatgatcataggaaccatcaggatattatacataacttctccgtaaatatgggactgaaagcagatataagcatatgttactgcctgaaaaagtccaaacgcatagttctcgatcttaccttttgcacacaaaaccacactgataattccagcaagaccgcttaataatgcgatcatactatctccccacataagtgataataccaccattgtcacacttgaaattaacagccagcttttttcaaacattgtccagtctttaaaataacttttaatcttttccatattttttctccttgctcaaaataaaattattttcttttaaaaatttatctgttgaaattcttcctctgaaatggaaggaccttccactcctaccactgcagccgaaaccctgtttgccaccgcaaccgcagcctcgaatgatttctggcacatcacagcagagatcactgctccgatatgagaatccccggctccgatcgtatccacgacagccgctttttcagacggaattaacattccgtgtccattttcctgtaaataggctcctttgcttccgacggttataatcaccctgttgtccgtcatctgttcaagctttgtggctgcctcttccatactgccacagcctgtaaaatcgattgcttctttttcatttaaatgtaacaccggatgcagtttcataatcctgttatgcttttctccggaaatataggtgattcttggacccggtgcataatatatatcaaggtctctgtttttttccaggaaatcaatgatctgatcaccgccatccccttcaatctcataaccacagatataaactgaatcatactccgttacatccagtgcatcaaaccattctttttcaaaagtacattcaattcctggcaatgtcaggaaagttctttccccgtctgattctaccatgcataagcagtatccattgtccattttcgtactttcgattgggctctcatgttctgcctgttttaatttttcacggatcatggaagcatacattcctgttccgatcggtgcaaacaatgtatatggcactgcaaaatgcttcatgatatccgctacgttataggcacatccgccaactgtcatcgtctgcgattttgcatagacatcttctccttttttcggaagttcatcaatctgcatcacgatgtcaagcatggccgccccgatcaccagacattttttcattttacgttcccccttcttttagctatgatttttgcataaggagtaaagtcaacctgattcgcctcttttaaaagagtgacatctgcctcttgcatatggtccacaccctttatgcctccacagatagcggtcgccattgctccgatcgtgtcggtgtctcctccaaggttcgcacatagtaatgcacattttctcggttcaaagctatagtaagcgattgcaatcgcacatggcacagaatcggcggtattgacccctgctcccatcatattatagagtcgatccagaaactcatcgtcatttccttcgtatgtctttgccagctctacaccataacggatcctcgcccctatagatgctgaaacagtacttgctcccagcgacatcgcatactcttctacggaaagaacatcttctatcatctgatccctgtcttccttctccaaagctgatgccactgccatagcaaccatacaggcaccagccagagtgatgtcactgctgtgcgtaatgtgggaaatctgataaacatagtcacacagctcttttttctggtctgcacaaaacaatgttccaattggcggaatcctcattgctgccccattggaaagtgcttcattcgaatatctgctggcgtcttcccctttttcaaaaagctccagcgtaattttggatgtaggtcctaaaatattgttttcaaaagcattttctctcttcgcccatgccaaaatatgactcgcaatatttgaagcatctggtttaaaatctgtctcgatcagactgtccaatatcgtgatcgcctgtgatgtatcatcagtaaaattacccctgtgatactggtatgagatttcattttccggatcaccatccataaaatctacaatttttttatatttttccagaaaacgcttcctactccaaagctccggcggcattcccattgcatctcccattgccatgccatagagaacacctagtattttattttccattttgctttcctttcttgttataatgtttgttcttgcttattataataagctatttatgttattatgtcaattgttcatgttatcttaaaattatgccttatttttatgcatattttataaataatgtttactttcttattttaacatattataataagtttaattacaggaggtatcacatgggtacaaaaccaaaatatgaagaaattaaagaccagctaatcgaggcgatccgccttcagaaatacaaaccgggaagtgagcttccaagtgaaaatgagctgatcgcagaatacaatgtcagtcgtatcacagtacggcgtgcgatcgacgagctttatcgttccggctatatcgaaaagcatcagggaaagcggggctacgtcaaggaatctccgcggcttcaggaattgagcactgtttccagttatacggaagagattctgcgtcagggcatgaccccctccagaaaggtattaagttcaggcttacgtctcgctaacgaagaggaacaggcaagtctcttattagataaggcttcccctgttttttatctgaaccgtattatctacgcggatgaaaaaccattatgctatactgcaacaacacttccatatgtttacttccgcgacatcgaaaaatatgatttttcaaaaaattccctttatgatgtgattgaaaatacttatatgaccaaaatcacttcctcacagctgaagttaaaagcagttcccgctgaacatgagattgcaaagtatcttgatattgcagacgatatcccgctgttactttcgtctgctgttacctatggtatcccacaatccacagaagttcccatcgaaacattccgcacctattatctgacggattactttgaatacactctgacgcaaaaacgttgaaactgtctgtttttctcatagtcctctgatcgtcaggaatttacaaaagggaagctgtattcattcacagcttcccccttattgattctgatttaatgtgcggattgcgtcaatattccactggtatctggtctcagctccgcctttttccatttcccagagattgtaatggaagttgtgttttttctgaacttcatcattagaaatcacatgtccattctcatcaatcttggtaccccagccattcgttattgctctttccctggtttcaagacgattggcttttacactatcctcgatatcaaagaatctcttatagcccggattcatcttatccctgtcagccttctgctttgtctcctgataatactttttctggtcttctccacagtaaaatggctgttttaccatataggataagatttcatataactcacgccagtcgagtgcaccttccttacgcacaccattcctattcttatagctgatcttcacatatccgcttctgattgagtactccacaagaccatacttattgttggaatatgcctttctttctgcattatctgtccctaatgcaatatccctgataaggtcaagtttatttggcataaacgcaaaatcagactgcaccacatccataaggaatgccctaaacggagtgtagcaactgcaatctgtcacaagaatctccgccgcatcacgcaggtcttcatcaagttctgcaatacgcttggcataatcaatcggtgtaatatactgaagctctgatggatctttttcagatgtttcagcctctatctctgcaccatattctgcctgtgttatcatccggtcttcatcggcagcttcctgtggtgtcatgccttttgcacttacataatctctgctagaagcatagctctccggctcatctggtattgcataatcatcaagctctgattctgcctcttccggttccacttcccggtattcagcatcaatgacctcatcatcctcacggagtccgtccatcgcaagttcatcaatacgaggtgtctcaggctggtattcccctgtaagaataaggacaccaagctctttttcgatatctttccacgaaacatatccttcaacctctccatcctcatctcgccactgaaaacgcagtccattcccatgaaatgtgtcatatccgtgcagtcctagtccgtcaaccggccagcctgcacctccctgaccatattctgctttgatacgctttgccctggttcctgcatcaatctctgtttcaaaaatcttgtataccctgcccttgccaccgataaaacctgtacctctcataagcacctgtttgatatactcacttggtactgtgaatgacttctttggattcaggtaattgtatttacctgctaatgcagcttttctgtcctgctcgaaccgacgcataaactgattattgttttcataagccgcatatgcgtttacgacgcattaagttaaattaaataatgctatcctctctaccgccttttcgagagccaggaagttccctctgaacaccttcatagtttattatccttccgcaacagtattgactacccttgctcgctccactttcatttctcaatccttcagcactcttcgcaagtatatttgatttccatcaggtatctgaaccggaattatcactatatctgtaattgttattcaattgtatgagctgctttgcaactcgcaggattatgatatagcaaaattttgattccttgaacttcgccaaaagaagtattttcaacatatctattctttttatgtcagtcctcatttgtggtctgttcgtgtttttattatatagtccacatttgtggttgtcaatatatttccaaaataatgtaccacttttgtgaactctgtgttaaaatattcatatcaatttgtttgaggtgattattaatggataatagacattcaattggaagtaaaattcaaaaatatagaaaattaaaagatatgacacaggacgaattatcaaaacagtccggtatttatttatctaccataaagaaatatgaaagcggtgaacgaaatccaaaaccagatcagcttcaaaaaatagcagaagctcttggcattagcgtaactgtatttcttgattacgatattaataccgttagtgatgttctttccttagttatgaagcttaacgaacaatccccattgaaaatatctgctgataaggataaagatggcaactacatccccagcagcatacacatgacatttgaagattcacaaataaatgaagctatttgttcttatctaaattataaacaacagatggatttaattgcctatgaggataacgataaagctgtgattgaacagcaaaaagaattttatgataataagattaacagattgcttttatttaatgaatgtattaaaaaaatccgctaaattgcggatttttttctttgctaggactctatcataatacttctctttacatatcctgagtagtttattccctactcaaatagctttggtaaatcgttggtaaaaatctactgtaacatccccaaaacactgtaaaatcaagtatttttaatcaaggttagcatattgccgtggcagatgaaaagtatttttatcattgttttgtttctccttgttttgccccggaatgccctgttttgcaagattttctggaattcgtgtagtttgctctgaaattacagattgtggcaaatcagagcaagattgagcaagttagtactgcctgtcagtagtaaaattggtagtaacacctcaaagtcttactacttagaatgctacactaaattttacaaaaaaaagaacccgacgcatcaggttctcccaggtgtaatccgaagacatccaccgcaattcttatatataatatactacttctgcataaaatatgcaagaattttatgatttgctaatgaatttttgtaaggcattcatattaggtctatgctgtgtaccaaccacctgattataaatgttaattggcaattcatttctcaaatactctgtctgctgttgatacgaagcaacaaactgcttacaagcagttttagtttcgcccatctttctaaggaaatatgtaatcataataatatacgcatccatatatttgaaatcaatattagaaatccctacttcagtttcaagcagagtaacaagacgctgatcaatcttaccagttttaaatctagtgtactggcacgctgatttttagcattacaacaacttcctattcggaagctgttgtaaacctaggatataatgaactcaacttcactcttgcatcggcagttcggaactgccaattaacttttgctgcgactgtattacgctcgacttcccacgcagctaactcttcacgaagttttgcaatgttttcaatccttcgtgacaaacactgtctggtcattacattcagttctatttctgcaatgtcaagccagctcccatgtttgggtgtatagtgaatttccaaacgcttgataattcgtcttgcttcatctgctggataccttttatacaaggacgccgttttatgggtgttaaggttatccataacaagaattactttttctgcatcaggatacatgacatcaacaagatattttatctcttctgcccagtcaaaggcagtacgatgttctcgcacgctgacatgatgagtgcctccaagcggttcgacaaaagcaaatatgctgcaggtaccattcctgacatactccgaatctgttttctgattgtcacccggacgcatgggcagtggtttccttgcatcgcccagtaactggtaaggcttttcgtccatgcatacaactggtctttcaggattgtatgggagttcatatacatcaaggacatcttccatacatgctataaattcggcatcatctttttgggggatgcaccagtagtcgtttttgtgaggtcgaagtttgttttttttaaggctcttcggattgcctcacggctgaccggagtatcaagaacaatttttgatttctcttccagcagccggatggtccaccttgaatgtcctttcggcaccggaccacaggcaagttcaatgatacgggcttcagcacgtccatcgagcacacgccttgcattatcagaattaacattacgcttaaactcagttactgcatcaataccaccctcaaaatattttttcacagtattggttactgttgccaaacatacaccatttgattttgcagactgctcatgagtcaatacttttccgtgggactcatccaagtcaataataatctggcatctgcatcggattgttttggatgttttattttttcggatgacagattttaattcttttaattcatcatccgtaagtttgattttgtacttttttggtcttgccataggatatcaccgccgtttcttttattgtaccataaaacggcaataacagccagaaataattgactaaatatcaatatgccagtacactagtatcgaaaatcacattgttatgagcaattgcatttcgcaaatctttaactgtaaatataaagaactttgtgttcatgccatctgaatctaaattagttgggagcttcattatatttgaaacataaagcttaacatttgtacaggcacaatcatataaagttccaaactcaccaagcgctaaagtttcaaatattgcccaaacaggtattgtaatatcattattaaagaaatgtgctaccacacttctcttattatagtcacgaacaagagcagcatttatttttccttttagattcattctcttcgtgtactctgttttatatgcacggctccccggagtataatttctatatgctgttaatgatttattgtaaataacatcaaaattctcagatttgctatctgccaataaagcctcaataacataactcttcaatgcattttctataaacattaccttaggataaagaactgttttaagtcgcatatcatatttattcagtgctataatttcatccaaagagctaaaattaacacggttagtatcctctcgaataaatctatatcccttaaatccatgataatagcccatatttctaagtgcttgtgtctgtgagcttttaacattgatatggtgtgtattacgtaaatatttcatcaactggtaaattgataacatgtataactttctttcatcatttataaggtttattatagcaccaaacacttactttttccacagaaaaaacgccccagcctaagccggagcgtcatctcttttccatattaaactaccttaaacatcttctgcgacatcgttttctctttcttctgctcaacctccgcctgtgccttcctaaactcttccatccgtttcaattcttcctcagcatcatcgaatccgatatgcgtgtacacattcattgtgaccgatatatccgaatgccccatgaggtactgcagcgtcttgggattcattcccgattttgccatattcgaacaatacgtgtgtcggcatacatgaggtgtgatgtttggcatctgcacccggtagatgtcattgtatctgccgaccatatgattgaatcggtgctgccaatgcattgccacaagtggcattccattatcatcgtaaaacagaaatccgctatatccgtctatggacttctccactttcggtgcatttctatcctcaataatcgcctgaaacatctgtgccacatcctctgtgattggcaatactcttgttccggcatccgtctttgtggtttctatgatatatcgcatatccgatgttctctgcaactgatggtcgatgttcacagttctattctcaagatcaatgtccttcagcgtcaagccacaaaattctgatattctcattcccgtatgaaagagtatgtacaccacttcatagtatttacagcacaccacatcgtcatgcacaaacttcaggaactttctcatctggtcttttgtaattgcctctcttgtgactgcgtcatttactaatactccggcaagctgaaatccaaatggattctttaccagaatgtcatcatccaccgccatctgaaaatctggtcgcaacactccccgaatggtatgaatggaactgtagcttttcccatcctcttgctgcaatttgataaggaacagctttgcatcggatgttttcacacttcatattgtctttttgccaaatgcttccttcgcaagcaatctctgcactgtaacatatccctgtttcgtgctttgccttactccggtctttgttttcaaatatcggtctacaagttcacagactgtcatctgtccgtccacgatatttacaagtaaatccaaatctgtgtttacctgtttttccaactcacgaagggaaaggcatggctttttgccctttggaagtttgtccgtatcctcatctgcattcaatgcatcctgacttactcagctttctgattatatcattttatacagttgatcaacttctgcttcgtatactgattcagtgtgagtatcaaacagcacccattccaccaaatcaaagctgtctggagtaccctgcaagaatctgtttactgtatgtactgcaatctttgctgccaactcaaccggaaaactatatactccagttgatatggaaggaaatgcaatagacctgattccattatccattgccagcttcatggaattaaaatagcagttagcaagaagttcctcttctctattccttccaccattccatataggtcctacagtatgtatcacataatcacatggcagattataggcttttgttatctttacttctccagtctcacatccgtgaagtgtcctgcactccgccagaagctccggtcctgctgctctatgaatcgcaccatctacaccgcccccgccaagaagagagttgtttgctgcattcacaattgcctgcacatctgttacttttgttatatctcccattaaagtcttaattaagtacatttagttccatcctttccagatatccggctgataaccaagtgttgattgctttccgtttcttactactggtgttttaattacttgtggattctcaatcaccttttctagcttatcttcatctgcgatatacttaataagagcaagtaaatccttgtccttaccgtcccagttaaccatattttctagtccaccatttgcctgagctaccgaattaaattctcctttgctcatacctttttctttcatatcaatgaactgatactttatgccccgctccttgaaaaaacgctccgccttcttagtatcattgcatttctttgttccaaatatctgtatattcatatcagtattccttttctatctcaacatctattccatacattttcttgaatgcatcaaggtctgcctgctgcacctgacttagtcccttgccgggctgcattttatgccactttcggatgcactccctgcagcatgttgctgttgcgtgctgggcaataaatactggatgtccacgcattggtgtctgtttgccatcatttactatatatgccggagcttctctctttgcaataaaatcctttgcatgttgtcttattgtatcaagacctttttcatttatgtaatcaatatctttctgcttcagatggaaactgcttcgaaacttggaattatccagtcgttcaaacaactgcctataccattcatccttcgtcatatcatcaccacaaatcgtatggtttcatggtttctgaatttcgatattcatgtttctcataatatcctatcagcttaccctcatctctgagtgccaccatgtaaacatctttattctgtttctcattatgaaaagtataaacgatattatggctttcatctgctgcaaaccagtccactacctgctgtattctatctcttaatttcgaattatggccgtctaacaggcttcttccgataagtttgtcgccgcctcgcttcgcatagctggtaacagctgccggattcatgtagataatctcatgtttgagattgcatataacaacggatgccctgtcctgatcaacaatgctcttataaaagctgacatatgatttaaactcaatcaacttttcattatcaagcctcttctgaagttgtggtttctttctccgataataatcgtatatctctccacctggtatccagatttgtgcctcatttatcttatcaagtacagctctaacaatctgttcatcagctaatgaatcaggtgctttttcatgttctgttacatattttttgtattcttcatacgcccagcctgtaatcttatccttctgtttcatcttgagattactaaacttcttgttcatctgtaaaagctgaccatctatctttttatgaatttttgtcttcttacttttcgccattttatgtcatccttaaaacttcactacttgtcgaacaaatcaaaatcaaaccgaaacggccatgaggaagcgtgtgccggtgcatcccagacgataacattatacctgttctcgaaatactgaatctgcttatcaaacaatctatggtctgccgtcaatcccggtagaaaaacaagggtaatttcatccgggtgtgaaacgtttgtccaatagtggattgttccgcaaggagtctgatatgttttttcttccattgattttctctccaaaacttccgattttctcaattctccaaacttgaagttaactaatggatgccattttatcagtcggccatgatctcctgagagccacataggagattaaaaagtttgcaagccaaccagctggtaccgcaagccagacaaaggcaatgccgaaacgtggtgcacagattagggcaacggacagacgaatcgcaaggttcaccatgtttgcaacgaggaacggacgcataattccgagaccgcgaagaactccatcggttgccatcttgatacccatgaagatgaaaaagtaaccaagccacctcatataatcaccagacacctgataggcaaacgccgttccgtcttttcctaagaacagcgaggagatctgcgtgtgtagcgtttcaatgacgagaaaggcaagaacggcaaagcacacgtccagcaccagcgccgcatggtagccttttttgatgcgttggggtttgcctgcgccaaggttttgggaaacatacggcgaaaccgcattgccgatggacacaaagatcaatgaaaaaacattttccaccctcatcgttgctgtatacccggcgagtgcctgtgtaccgaaaggatttaccactgcctgcacaatcatcataccgatagacactgtggactgctgtaaaaccgacggcaccgcaatgcgaagcatggaatacagctcctgccgttcaaacctgttaaaggggcttttatattgccgcatccgtgcaaagaaaatcaaaaacgaaaacactgcggaaattccctgtgcaatcaaggttgcaatagccgcaccgaacacaccgagacctagcccggccaccatccaaagatccattaaaatattcaggatggacgaaaaaatcagcagtcctagcggaattttggattcgccgattgaggtgaacatggtagaaagaatgttatacataaacagaaacggaaagcccacaaaatagacccgcagatacagtactgcatcatccagtatgtcggcaggggtttgcagtccactcatcatcgagttggcgaagaaaaagccaaaaacaccaaggactatacttagaagcaaaaagctaattaaggaggttgacacgattgttttcattttgccatactccctggctccgaaataacggctcacaagcacaccggctccgacaccggctcccagtgccacacaaatgaacacattggtcaatgctgcacatgcaccgacagctgcaagtgcggaagaaccaacaaactggccaacaataatagagtcggccatattgtatatttgctgaaaaaaacttccaagaatcattggcattgcaaaaaccgtcaacgctttgaggggcgtatcggttatcaaatactcatctttcgacattatcatattcctccatggtatcttgtatcgtggtatcccattcacttaccttctcgaattccgatttgtaaaacacattcttttttacataggcacagtataccacatttcctgttcctatgtgataacatttactgcttcttccgatatgaactcatcttctccacagtaacctccggatagaagtgaataagaatcgttgctttctgctctgcctcatcctgcatggagaatcttctgcttaattccttatgtaagtgaaaagaagtccccgaaggaacttctttcgccacaaatcatattcttttttatcgagggaagtccggttgatgatcctactgttttacaaaataggagtacaatggggggacaaatcccatccacattccctaaaagccttgattttaagccttttcagccaaaagtacggtttctgggcaaattatagcatattgttgcaagtctattcttacaattccatcagaaaatgttcatgcagcgcacgtttcacctgatcgaaattacctcgctccggacattggatggaaacaaccaatcccttctctgggagaatcgttgtaatctgtccgaatgcgccatcagcacgataggatcctggatatggactgatccagaactgatagccatatcctacatgccagagatctgcagatggctcgaaggtaaatttcggggtggacacctcctgcacccagtccctgctgacaatctgctcgcccttccagttaccctcagccagatagagctgtcccagtttcatcatctcggtacaagtcagatacatacctccgccgccattcggatgtccctgtggatcatgctcccagagcggccatcccatatcaaggggctggaataccttctcatacagatactctcccatccgcttgccaacggcccgttctaccatatgagcagccaaaatactgtcggcagaggaatagcagaatgcactgcctggctccacaggaaccggctgtgccatcatatatttctcataatccggtgcgccgacgcccggacgtctgtccgcattcatcagaagtgccttaccaaagccactggacatgcagagcagatgtttcaactgaatcttctccagatttggatccggatttgaaggaagtttatctttaaacacttccgccacatgatcttccaggcttagttttccctcttctattgcgagtccaactgctgttaccgtaaaactcttggtatgtgaataaatatttctcggtgcatttgctgcgtagtgcatctcacagagtaccttgttctcatctccgacactgatagcttccagcggcagattgtggctgctggcataacgatgaaattccaaaaacttctcttccagtaacataatacctctatcctttccggcaaatctctgatgtcagtccgatataaccgatgcgacgtgtcgcaaggttaaaaccaatctatctgacatctccaatctggttctattatctcatacacatctctgcatctgtcggcagtggcatcagcggtgcggacggcagggtctgataccaataagcaacactggtgtaatcatcgtaacgcggtccggtccagcccatgttgtcgagtgtcatacgaaacttattctcaaaacggatcgggtctgcaatatggaaatgatacagcaggaatctctgctgtccgttatagaattctcggttgtctccatagattgcatacatgccggtatataagccgctgaaggtctgatagctcttgatgatgatgtcatttccaaatccataggaaccgccgaagtagtcttcagttccggtatagtggatagacggatacggatcatcgtccagatacatgcgggcttcgccttctacccaacaggtattgttgccattcataccagttgccagagtcacaccgacaaattgtcccctgccttcgattccgtcaacgattgtgtaggtacgacccttctgaaccgggtgctcttggcgataggtggcatggaaataaccagcctccgccggaatctcctgataagctccggtgataatataatagagattttcatccttgtcaccacggttttccatcgtgatccgagctctcttatggaacggcatctcaaaatagctgttatagccgcgaccaggagctaccagcatcatggcagaattcaacaccggatatttgccatcccggtccacgaaattttcatcataggcacatccgaagaatgcagagagcggagcttccacagacggatattcctgatcatcccaatacatacggatgataaaatggtgcccgacatatccggtaaaccacatatgctggatcacacccggtcctgcagcatctaccagagttacggtttcccctgcaggaatcgtcacggtcggacgaagcttggtgcagtcaccgccctgggaaccacctgcgcgtacaccggttggattctctgcggaaaatgcaaacgtttttgagttctggatcatacaatagttgttcatattcttctcctctctgatcaaacctggatcatctgaaattattgcttactacactatcgcgtttctctattcactataacatttatctcccatgaagtgacggaattacagaatcattccgtctgcgccttctcattttcttcccggataatctcctttctggcgttctgtacacgcgcattgccagtaccacagccttgtcctcaaccttcacattcctacgaaataaattctttgacatattagttatatagtgttagtataattatagaaagggtgctaccgatagacggttagcccaagtaaattagtttgacaaaaatgccgcttagtttaccagacgtgggcggctatttttgtgtcttgttattatccttaccaaaggaatatccgattccaaagcaggttaagccgaagcttactactgcaataaagtcaacaatactcatatggcttagccctcctttccttggattcccttacggttttctatgtaatcagagggtcacagtccctctgccgaaggactaaccgcctaccgttatggtagcacccatgagcaattgtatcagacagaattcaatttatcaattcctaaaatatttttactaccctttaatctatctgttcgttactgttcagacgcaagcttgacaccacgctgtcaagctatgcgccatagtattaattattgagtgattacagcccatttaaaatgcctcgtagaggcattttaaatgggctgtaatcgttgctggtaacaccgttaggtgtgaacagtgacttatctagttcttatcagccgccagtatctgatcgatcgtcttcatcagctgcttatatgactcgtcattatcaataccgcccatgatcggctctccgataatatttccgttacggtcaagcacgattgtagtcgggaaggccataatgcttgttgcatattttccggcttcactgttggaatcaagggaaagattcgtatattttgcaccctgcttctctaaaatactcttagcttcagcaattccatcctcatttccgtcaagagaatctgtattgataccaattacctgtccgcctttttccttcagctcctcatttaatttattcagttccggaagctcctgtacgcatggagaacatccattaaaccaaaaattcaaaaccgtgaccgcattctttgaaatgatgctgctgtccacgtcatttccatccagatcctttgccttaaacttcggaaatacgcttgctccctctttgccggaatccttatttgatgcattcgcacactgcttctcaagaagtggctgaagctcatcctcaagctttttgatttcttcaacatcttccttcaaagacttgagttcatcatcggtaaacttatccttaattttgtctaaagagtttgccagaaaatctccgtaattcgtagctgtcgcatccttgacagttgatttgtcaatgctgttaaataccttctcccataaagccttatggttttcaagaatactgttctctttctgtgtcaattcattaatctttgcatccagatcttctgcttcctgcgttgacatctgcgactctgttgctgtattttccttgttagcagaatttccgcacgcacttactccgagtaccatcgctgcaataagcagcatcactgttaatttcttcattttattctcctttattctctttcaaatttgttttatctgttccgaatccatattgatagtgaattgcttccgtcgggcattcctttatacacatgccacagcggatacattccgtatggttcggatgctttgtgacatccacgtccatcttgcaggctctctcacatttgccgcaggatacacatttatcctcatccaccttcatctgcagaaaagataccttattgcaaagcgcatagattgcgcccagcggacatatccatttacagaatgggcggtaaaacataaggcttaggattacaaaagtaataagtataccgaatttccatgtaaacagtttgccaagggccgctctgatacttgcattggcaatcgaaagcggaatcgctccctccagcactccctgtgggcaaagatatttacagaaaaacggatttcccattcccagtgaatttgtcaccagaaggggtagtaaaataacaaaaatcaacaacacgccatattttatatagcgaagcggcttaagctttttcgttgaaaatttcttaaacggtatcttatgcaacagctcctggaaccaaccgaacggacacagaaatccacagataaatcgtccgagcagtacacctaacagaattaaaaatcctgtaatataatacgaaaatttaaacttggatgagccgatgactgcctgcaaggcaccgattggacacgccccggatgcagccggacaggaataacaattcagtcccggtacacagacggtctttgcatcccctctgtaaatctctcctttaaagaagttcggcagatggatattggtaagaatcgttgccacggcctgaatccatccccgaaagcgcgccagaaactgtgatattttatgttttttcttatccaattccaacacactccatacataatttgattgcctttgagagtaccgtggctgcctccccgcgcatcgcaccgtatccgatcatcaggatcgctgctgccagaagcgtgatctgcgctgctgctctgtttatctgtttcatatcctttcccttcctaagttttaacattttgtcgttgtttacgatgataatagattagcaaaggaatatgaacaccctgtgtttgaaaaaggaagatatctttaagatttgcgctctaattcttaagaaattattgagaacttttcaagcagtcccaccttattacaaagcagttttcgtattttccatgattaacggggtcagaccccaatgtgctgtaatattacttgtcccaagtccaactctaccgcacatatcactggcatctttatctactgcaagatctaatttctccaataatgccatacgccttttatccaacatggtctcgctttttatttgactcaacggaagatttgtcgctatgatcaaaggtcgtcccgaacggattctgcggtctatgacactgaaaataattcctaatgcatattctgaatttcgttccactccaagatcatcaataatcaaaagctgataggaagccaatgcattgatatattccgttttatccaccagtggaaatatatcgtcgataatggtattaaaatttgtcatctttcaattgtttcaatcgtttatctatatcatctgcatatcctattttcacataatccggaaaagaaggatttgtgagaatgtatattacgccttttttgtcattcatatccgctttctccatttataacttaattctttgtttgccttttcccaaaagtcattttacctattatatagtctggaaattagctcgtttaatattcaatcctaaaataatccaaatacgccttatacttatcttgtgctgtcagacaagtatcggtcagataacctttttcgttgtcccattccttcaatccacgataatagaacagcttcaaattatcctcaataatgaacggaacaatattgtatttcagacactccttaaacataatcaatctgcccacgcgtccattaccatcctggaacggatgaattcgctcaaacttcacatggaagtcaagaatatccgcaaaggccttttcttctttggcgttgtattccgttaacaatgccttcattttatcggcaacttcttccggaagggcggtatccatgccgccgacttcattcggaagtttcttataatcgccaacagcaaaccaatcttttctggaatcactggtgccattcttcaaaaccaagtgaatttctttgatgaatttctccgtcaaagtcgcttttgcatggtcaataatcatgtcaatgcaacggaagtgatttgccgtttcgatcacatcatccacattcagtacttctttttctacgccaatagtattggtttcaaagatatatctggtttgatcgtatgtcaagcggctgccttccatatggttagagttataggtcaagtcaatctgtgtcttatgataaatcccaccagtatatttactggtcttctgctcttttagaatatctagcagcgtaatcggttcttcttttttcttattggtgcgctccggtttctctgcgttttctggaatgttccatgtcttaccagtaagaaacgcgccgttcacacgcccctttgcacagtaatttctaacactgcgttctgacatattccatttttttgctatatcagcaactaaaaggtatttcatctgccatcccccatccattataaattaaatccaaaacatactaatctactgactagtatatcacactatcggcaaaaacactatcgttttttacctatttatcacactttttagccgatacaacaactgtttcctagtcgaatagctttattaaaacggatgctataaatagctaatattctttcaaatgatgagtttataccttatatcgtctaataagttttactttcattttcgcacatgatcatgaggcttttttcgttctaattgtgcgattatacgtaaaaagatgactgttcttaatcaaaataaaaatggcgaagtgcttatcgtaacactccgccaaaagtcccaccaggttgcgcatgaaaaatcagaggcattccgtaattacttttacagtttctaccatatacccctgatgtctaaattctttccttaatccatatccgatttccactacgccatcttttccaagacccttgaagcagaaatcgccgacaatcgttcccggaacattttttaattccatgttccagactgcataccatattctgttgtcaggttccataaggcaccctccaacatttcggtatacgcctgcttcatttctgcgtccgcttccttttcaatcagacagctcatctcatcgttactaattggatataaataaagcctttccgtttccattctcatattagttcaccttatacactgtcttgttcttttactcattgtcattcgcccctctaaatcatccaatagaaagtcctaattcgtatgctctatccagtccatccgtattttttacatcaccaatatcctttgctccctgcacaagtaccatccctgcatcttcaagatgaaagaaactcagtacaagcttgtattgcaattttatggaatcaaacagttccggcagcgtagctgctccaactaatataagtgccagttttttaatcggaaattcatttcgcatacttctgccatcatcgactgcaatcacagccttcataaacatgttctgtccaatcagctgtccatctaatgtcatgacaaaatccaattctggaacaaatgccggatcgttgcgaagctgatggagtacataatgctccagacagcctgggcgatacacattccagaaactctcccttaccagattttctacctcatggtattcattttctctttccaatcgaatgataatattttccttcattttccttttctccatttctttatataatgttactaatacttttttcaaactgctcttttattctttttttatcctttgctccatcatacagactatagtagaaaaacatgatggaataaaacatggttgcttttttatctgcctccacaacaccaatgctctcgaacatatctttcacgtattctgccggaccggacacaagatactgctgatacaatgcctgcatctcctcattccgaaactgctctaacgtaagcatctttcgaaatgacgatgcaaaatcattttctgtccaatacgaaaacatagatttactgtattccatgaaattgtccgcagaaatctcttcatactgttcaggttcattttcctttttatcagcaggcatatcatgtgattctgcctgttcgccatccccctgctccatcctttttacaatatgttcaaaaatatctctcttactctcataatgcctatacaatgcaccttttgtcatgccaagctcacccgcaatctgactgacagaaactgcttcatatccatctctcgcaaataaatgtaatgcaacaatcaatatatcttcctttgtagtttttgacatgcacaaacctcctgttccataaaataaacgaccgtttacatttcaattatagtaaacgatcgtttatttgtaaagtcagacattcctctctactgctcttgtaaagctggctgcatacgcctttgtagcgtaataggtcgtcataaatggtcctgccggaagcattcctgctgagcttgccacatttaggatataaccgccgtactgcttttccatctttttgaccacgctcttggtgagataatgcactgctttaacattgacatctagtctgaaattttttcctcgtgcttctccataaagtaaatcctagacccaaaatcctgaaaatatctggtcttgtcactatatccggttgcagcaaagctctggtgcagcttcacaccgcccataagcacggaacctcttgctgtgtactcttccttttcacccggcatggtgacaaatttggcaagcacattgtgtaccagtgagtcctgcttcacatgtataggggccgctgtgtttaccagatctccaaaatttttgatatacagctgccgctgtctcatacgcatctccgtctgcttccagttcagccgtacctgtgacctgctccatcgaccattccagtccatccgggtattcagatgccatcaatgacaatccaccgccgatcacaactgctgcgagcgccaacacgaccaatatctttttaaatgacagctttccggcctctgcctgtgtcacatcacttccgtataataattccgttctcgcctcatagataaatacgagcactgccgccgggcaagcatacatcgtacctgccacagccggagtgaccagcgcatctgccatgtgcataaaaatccccccctgagacttcgttttttctgtacctactttaccatagaactgaaaaaccacaagccccagggggggattgtcagccagacaccgacctcccattactgtttaatcgtgcctcattccagtaacgtatttccaacaactgttacttcttctcatttacggttacggtcattcttatgacctttgactgaccgttttgcagtctgacaaccgccttgacgactgtctttccgggcttcagccccgtgatcctgccatttgagctaacgcgcgccacatccggattgagaaccgaaaaagtcactttatcaacattgtcccagtttacccctttcttaaaccaaaagtacgtcccctgcttctcgcggatgctggctgattgtttcgtggctttgatcgaccgcagtatttgtttcgtgagtgcttcttcctcatcggctgtcactaactcataggttccgtgacccagctcattatgatccagttcaacgcttccatctgccgctaccctgaaaggcattttactgactacaagcttctcacctgtttctggatctatctcgatgatcttcatttttttaggtctcacggttcttttcagaagcgtatttacattgaccgtcacttcccggatgacccagtcgtttttcgtgagcatcttgatcgtggtctttaccttcttcgtgcctgctgcctttacgatctctgaaagtgcttccccggagatcttcacattgccaaaacctctatcaagaatttctgcggtagctgaagtgatcttccctttggcattcttcgatacattgaccacgatattcattcctgtcttttcatttctgatctcggtcctgatctgtatggaaccgtcctctgcccggatttcagtcgtggtcacaactgtaccatcttctctggtttcggtcttagtcttagtcgtagtcttgtccttgttatcctcctgtggcggagcagtttcagatccgctgtcggtggaactgcctgatgagctgctgccactgcccgagctactgccggaactgcttccaccggaactgcttccaccggaagtgcccccatccgaactgctgccgccggatgattctttcgcaaatacccttccgaccacatcactcatgatatgaccatcttctatcgcaatcgccttgatcgtagtcgtctctgtcagcgtaatcggtgttttgtactgctgcgatccctttgttggcactgtatcatctgttgtgtaataaacgattgcaccgggggtcgttgtgatcgtcacctccgtgcggtccgaaaacttgtcagtaccggagatcgtcggaacgtcgctgtctctcggagtttcaatcttacaattgccagctgacaaaatattattatctgatccaaccgctttgacgtgaagatcaaccatctgacgcgcaccaaacttctctttcgtctgaagctcctgcaatgggtaataatctgtgccattgatactatactgatagctcatcgtatcagtatttactagatttgtcacctgcataacatatacggtagcgctatcgtttggtcctatgaccacatcaaacgaaagtggtttctcctgtggctctgtgccctgatctccggactctgccgccccggtgttgtcgtccgcgtataccgtttccggtgcgagcaatccaccaggtacactcatggatgacacgaccgtagctgcggcaatccccaaggtcaggatttttgctaatgatttgctttgttttgatttccgttgtttcatttttcgttgtctcattcgtcgattcctccttttactgatgctgttattaggcgtttgcgaaactatttttattatctgggctacctagctgtgggcgcagtagcattctgatcaagctgctctggattttctctgttaatccgatctacaatataattgatagaatctttgatgttagctgcattgataggattgttcgtcttagaagtaaataccagatcctcaaatccttctctcggagaaaaccgagtcgcaatgtctttatggtatgttctctgatatataagcacatcatgcactttcttaatcattagaatcttgcgaaatcctgcatatttattttacccatataattttctccaaaaaaatatggagaagattatatgtctctcttctccataaatgtatcatgtttatcacttaatgtctacggcttttaagctagggaaacgcatcctaactgctccttgactttttcgccttctttttctataataaagacaacaagggaagccgtagacggtttgcctatgaacagttacataaataaccgcatctttggcgaggggcggttattttttatgtccaatctgaattaccagactgatgacagcaacgagcaataaacaaaattgaaacaattctgaatatgtaatcatggctaaaaaccctccttcgtgagggcaaaccgcctaccgtttctgcttccctatgttgtgacgacagtataacagatttcggcatgatgtgcaagaacaagtgttcctgccagataccaagatcccggtatgaaagacaaccattcgctattgcatatgctaatttgctctcacaaaatacacttcttcctaaaacagatggtgataattgtctgtccagaatgagccttaatccttcctccctcgtcccttcaaatccagggcagaaaaagtctatcccatcagacatactctttgctatctgattgtaatcctctccaagcagtttttccgcaatatcatctgtaaaaatgcgaatgctgttattattataatgataagcccttgcaaaacagcttacctttgctgtcatattgtccattccaatccccctcgtactacccaaatagtatttttgccacaccattctatttcagcgtatgaatatcctcaacctacggagagtagagttcgaatttgctcatttatttttccatcccatccagaagctttataaatcttttatcattcatctgctcattcgtaagatattctccattataaaacaatgcataggttgtaaccggtgtcggagcattctgtgcttcttctttcgtttccagtctgtttgcctgaaacggaaccgctctttccctggcaacttcaagaagcaccggaacatactttgcattaaacggacattgattggtatagtacaatacatagcctgtctgctcaatgtgtggatgcttcgcacactccttaaattcaggcttagccgcatccaaagaaaaaggcagataccagagctgaataccattatccgcttcatcgcagactgtaaattccttatacttgaggaacttcggatctgccagaaaaggctttttcttagtggctgacaggatacagattccctttttctccttctctttgctgtcttctatacaggcattcagtaaatcattcgaataaccattgcccttgaaagaaccagccacccacagacagtcaatatacatatagccatctgcattgatcggattccatgcattttctgccggaatatactcgataaagcattttccacgctctatactcttgagaaataccaatccatcatcaaatcgctctttcagccagtttttctttgatattgcctgtatatccttgttgcttgaaatcgcacagcagatatgctcgttttcaatattttctttcgtcactcttatatattccatggattttctcctacttatatcttctgcacctcattgtccagcggatagtagtgcataatatacggaaacaacaacaccagaaacaataacgtcaacgcatacaacaacggattgcagatcataagcgccgccacaattgaaatcattgtcagaatcgcaaatgtaactgtcacgatcagatgtaccagcctctcatgttggaaaaaaacaatctgtgtcaggtgttcctgcagaattgcgttccattgttccggagagatattgtccgcattggctaagagtgaatctattttctggcggtaggttattattcttttcttcatttttacattctctttcttatagtacctttattataccaatatacctttggaatcacaacgacatatttaactgaaggtaattgtccatcaagatatcttgttattgtaagttccccagaaaaaacaaagggcagtgtctgaacaacatcgccctttgttttttataattatacttccgaaaggaatctgtcaactggtttatgcagcagcgtccacttcgtcatccatatatccgtcatcggcattttccgaatcatcatccgaatcatcatccaaatcatcgttccagtcatcctctgtgctgtctgtgataacaaccttgcatttccacaccataccatgtacttttgctttgactgtaaccgtaccgctgctatacggtatcagtatgccatcctctacctcgcatatatcgtcatcagaagatgtccattccacgtcatgactgcatcccttcagatccagagaaaccgtatcttccacgtccatctccactgctgtcttattcagttccggcgtttctactgtcacctgacaggatttcttctgcgttcccttctttaccgtaatggttgctttgccttttccttttgcgaccacttttccggcggagacaccagccaccgctgtattactgctgccccaggaaacgattcctgcaccaccctttaccgtaagtttcctgctctgtccttttacaagcacaatctttgtactgctgatcgacagcggacttatcttcggtctggtgttctttttcttcgttgtcttcttcgtggttgtcgtggaagatttccgcgtctgcgaatatccgcccgatgagccaaaacacttcttgcacggtgtcagaccgcgtgccaatgcattggaaagtgtcgtctgataaaaatttccccgcccgcatttgtgggtatggtatttactgccggttggcgtcacatagaccattgtctgtgcctgtgccgttaccatgccggcactgtcaccgactggcaaaatcatcataaaaaatacaagtgtaaaacttagaattgtttttttgattgttttcatcaattgcctccttatcttttcctccgctttaatcatgtcttatatttttatcatacgccttcctattttcgagtacaataccattttcccaaattgacaattcgcgttttgtcaaaaaacatcttcacgtcctgccgctatcgccagaataaagccacttgtgaatactccttttgtggttttcttcgcagttaatacattaagggacgcaagtggttttttcaatatgttgttattaatttatggtgctgggcttccaccattatgccagaagcctctattttatttctattttttcctgatatccggccagccggtccaggcgcattttttctgccaccggaaataactctgtatccgtgatgcgttccagactttttatccgtttctcggaaattgtttcattcgacttgcttttttcataatcctcaactgtcatgtgccagtaatgaaattctcctgcataatactcagaaattttctgcgcaatcaaaagcccctccggatccagatctcccgcataatataccaccgttcccgatgccgccagaagatctaacgtaacaagccctgccaatcgcggctgcccgttcatacacatacaggaaacctgctttgtgtgccctgcgcaaaggcctgcaaatacggacggattttccacgatatacatttcattatctttgcaaaatattctgttccactttgaaaggactgcaagggcaaattctgcctcgtaacatttccccctccagatacgcttttgttccagaatctgtttctggctttcgcctgcttcttcctgcttacgcaatgtatccagatgctcctttattccggcgcgtttctgcaagcattggttcagatgctctggatattccttcagccatgtaatacaggcatccagccgttccctgatctgttcgtaatccgtcagtttcaattgctccacgatggatgcatgttcttgctccagctttacaaggtgacgctgcgcacccgacagatcataacggatttcatccaaatctgcatcaatgctttccagacgcctggtcagatctttcatatgccttacactctgtaaaaacatttcatgcgcagactttaacgcgatcagattcttttcatactctgctgccgcatcctttgcttcctgaaatatggcatacgtacattgcagatacaactgctgcgcaatttctatcgctttctttttcttttcctgtatctgctctgaaagtttcttccaacgctcctcgatctccttacactctgccgttttcgtttcatatttgtgctgctcctgcacaagcatcttgaaagctgtacgtatacccgtatcctgcggcaaagcctgatattcctgctccagcttctgcatccggattacaatcccagccttttttgcttccaactggttcttgctgctttgcaatccctgaattttttctttgcagactctgatctgttcctgacgattgcgttcccgtgcccgcgcacccaggaatcctgctacatgctctcctgtaatcgttccagacaaaacgcccatctgataaataccttctgaagaaaccgaaatcatgctctcctcattatatgcaataccagacaaaataccggtaagacgctgatttgagaaaatatcattcatggaatcattcaattccaaaacgtccagcagactctttccactgtaagacttctggacgaacagataacggtcttcgcagccttcttccatcgtcagcacctgttcccggtaagacgcatccacaaccagtgcatccagaatccccatcgaaagcaaagcctcttccaaatgattgcattcctgttctgtcagggaatccccaaattcgattgctttataaaattcctgatacggaatcttcaatgcatccagacgctgccggttctttctaaccgcttcggaacgttccggctgtggatcttttgcgttttcccattctgtgagttctgcttctgtctgttccttttccagacgtttctgctcatactctttttcttcttcctgcatttgcagttccagcgggtttttataagaaaaccagatatctgttaccgttttccgcacctccgcaaaatcagaagtttctttaaaatcctgtgcatatctgctacagtctttcagctgttccgaatcaagaataagctctgtattcgatctgttccatgcatataaagcctctttccatgcattctgctcctgaaccaaagtatgatttgtgatttgtttgaacttcacacggccgcagaggaatatgtctatcttttatcattagatacaaaatgcaggattcttggcatatttgaagtggggcatggaacagttaatgcctgtcttttacatacaaggaagattatgattagaaatcttctttgtggagcaggaacatttattgtagttcataaccacccatcaggagaagtatctgtttcaaaagaagacataagcactacaaagcgattatttgaagctggaaggcttataggaatagaacttcttgaccacatcattattggaagaaaagaaaatggtgacagttacggatatgcctattacagcatgaaggagcaggggcttttaacaactgtataaaagtgataaacagggaacttactgttaaagtagctgacttgaaaaagtaaattccagtgcaagagtaaattccatcggcttttaaattttgctgattttgcaggagtttttttaacaaaatctcttgctttctgttataattaagctagcttatcgaaattttgttgtttttatggcatgaaaaacaggctactggaattcggtgtgtcagactaaattccaccagccacatttaaaaaatgtgaaatgtttacttccagtctgacagcagatttcgatcagttaattagttacttcttaaagcgtatcagcttaggcgttaaattgacttcatctggtgaaaccggcttgagctgaaaggctttaagaacatcttctccaagtgtttccagggcagcatcatacggcgttttgccgtcaaggctttctcttggagtagagtttatgtgattcacaataagattgacatcccattgggttagaaattcaaaggatgttcctttaggcaatatcatgcggagcatggtatgcgcctgttcgatggttcctttttgtccgctacgcattggatcacagtaataaatgctgcttctttgtatgccggtaattccagtttctaattcttctgggttcccaaattcagagccacggtcggttaagatattttcaaaaacagatgtaaattcatacgttcccatacgtttttccaaacggtcaaatacagcacggacggcaccttttgtgcaccggttaataagaaatgcaagaaacagtttttcctctgtaaagatcatggttaacagcgttttctgggagtcccttgatgactttactgtgtccatttgtacataagaatttaattccaaagaacagaagtctgcataggttctgttggtaaatacttcgcggtctttgatctgtgttttgtggcactttcttggtttgaattttgcctgccttttcagatctacatttctggctgtgaacagtcccttatcgatgtatgtgtacatggagcggacagacatatccagttccggatgattgatcaggatctgatagggtgactgtccctgtgcgatcaacggagtaacaatctggtctttttggtgcagctgatgccgggtcatatttatcccggcacgggaactacttaataattcgcggtacttacggtcggcaaaacgggcatcatagcggtatttatgggcaatggtacaatgattgattttcattggacagccattacatacataaggcgccttatcaagtctgcagcaccgttccttttcgaaatccttacaggtttggttgcaggttggacaggatgtacatttaataccgcagagcatgatttttccacaggcatttgtttttttacagtgatagcggtgtacacaaaagtttttggcattgtagaaagttcctttgtggtaccagtcagaaaggcgtcgtgatttaacctcttttgagatggttgtaggatctttacaaaggaatgccgcaatgtctttaaaagtcgcacctttggataattcgttttcgatgtagatacggtcattaagtgttagatgtttctggtttccagggatatatttactcatgataattctccttctactgctgtcagaaggaacttttacaataacactgatgtatgaaagagtaaatatctactgtgcaggactaaattctaccgccctgtagggcagtggaatttaaaatttcattttaggtactgttaaagtaaaaaataagagacttgatttctcaagcctcttattgtataatcatctcagaaaggttatcggatgcgttatccgattgccctcagtaatttaaatgtatttaagaaatagcatccaactttctcagggcgggatgctatttctttttgttatgattatctatgtaagatagtgccgcaaaaattaccagcaacaaagttaaaacctccattgtgttcatgggcatcaccctctttcgtaaaactagagggcatcaaaagaacgcatccgcttctttctatgaagttatacaaaaaatattctagcataaatctgtagaggtgtctatttgaaactgacaaaatccctgttacattttattagaaaaagaaatactttgcatatatgaaggaaagagaatatttttctttggattatatttgtaattaagagtaggtggttagcttactcgattcacatatttcgtggaaaatttccaccatatacgagcaatttggtaaatagtcaagaagtattttggtaagcgcatagttttagggcgtaccttataaatgaaatctgacaccccgcgccaggatgccagacatgcgagtatttcactacattttatttacaagtttcctgagccaatttactccacggggcaaattgttccaattcctcgtctgacatttcagcaccaggacgatgctccagaaggaagctcagatatttaagtggatcaagttcattggcttttgccgtttctatcatagaatagattttcatactggcttctgccccggctggtgtatcacagaaaagccagttcttacggccaactaccaatggtcgaatgctgttctcactgagattattactcaggctgcatgcaccatctttcagatagttcatcataaacggacggcaaccattggaatagttgattgccttgatcagcctgtctccggattccggatgcagctggtcaagccatgacaaaaaagcctctatgacaggtttttgatccttcaggcggcgattataaatctgtttgggcgataatcctttttctcgataagatcgttcatactcaaacagcttattacagtataggaatccctgatcttccgtttccttgcactgtggacactcataggtagtcgcataataatcaatacgctccagctttggctctgtataacgcagttctgtccggatgggttcgtgtccgataggaatcatcattgttccacaaacatcacacgttttctgttcttccgtaagagtatctacataaacattctctgtcggaagatcagcaaagacctcatcataagcagctttcgatttacgggccttcttgtgtgcttttacctcaatgtattccaactcaaggggcaccggttccggttcatcctccgtctgcaggtggaacagatccaactgtcccgggagctgttcatgccggatctcactggtggagccaaaaagtctggtcttcaggtagtccaactgtgcctgaaggttagcgatcagttgatccttttcgctgtctttggcatcacgttcctgcagcattttctgcagggaacggataagctcgttctgagtgctgattgtattattcagttgtgaaatcgtatccttaagctctaagagctggatatcccttactcctgaaggcattgttttttcgctccttttctatggttcaattgtaccataaaacaagcgaaaaatcctgaaaaatcaagcatttccggtactttttatcgcctttggctgctcgatttcaagacctgacataagccagtcaaattgcctccatgtaatgggttttacctcattacggttgcgcggccaacggtattttcctacgttggcatcaagtcgcttatataaaagtacaaatccttcacgttcatgaagaagcacttttattcgatcactacgtctgccacagaagagatagattgcatttagcctggaagggttcatattcagctggtcttttacgacagcgcataatccatcaatggacttgcgcatatctgtataaccacagatcacataaatcccgtctgcgacagtgatgtctcctaacatgtccctgtcacagctttaaggatctgtgacagcagcttcgggtcaacatcatttgaaatttttattgaaacagtcccaagcatgacctcgatggcggggcagggttcttccagcggaagcattgtgctttcgacagttggaatgcccgggttttgatgatcaggtataacctcaagttttacaacatccggtttaagggccggcttataatcgccgcgtcctgtggcagaggggatatcataacaagctttttttctcagtcttttaacccagttgtaaaaggtgccgggattgatgttatgttctgtacaccattggtagtcactaagaccgctgctgcggcattccatgataagttgatattgttcgtttgctgtgcgtctttgcgtcttcatacaggaaacctccatagttatagtaaaacgctcgcatttatagtatctagcgccgatactgtagtaaaatgctggcatctatcatctataattatggcaaattttgtgatgattttaaatccaccctgaaactaggcgcttacttaaaaacagccagaaagttcttcatgcgcagggattccggcaggcacatcgatattatccggctgatgatgaaatatgtccacgcagtgaaagacaggttccggctgtttcaacggcctctccgtggaatcagcgcaattcattttgaatatcggtaagttctgcaactgaatatccttctttttggcagatggacagcatctgtctttttggcatacctgtttttggctttttgagttcaaaatatcggatatttgacaacaactgagctatcgaacaaaacttcgaacaactggcttaatggcattgccccttgaacgaatcagaagaacctctccgtggcacgcaaactagaaaacgagacggcttatgccgtctcgataaaagtctttttcatattatgatacctttttcacttttaacttataacaaaaattcctatcatatgatgaatatttcatataaactttctgtccttttttcagagaaactgttccaatctttttccagccttcaccactatctaatcgtgtactagcaagacacttatatgaattattatataatgcacacgtcaaactataataatgatcaatatcggtattaactgccttaattatgtattttcctttcgttggagccgtaaatacataataatcctcatcatccaacatcataattccattatatgttgtattcagttttaccttatctgccgagctctcgctattattgctctctgtctccaaattctttatattatgttctactacacgaaatttataataccactgataatcagattcggatgaagaagaaaaaatcattctaattttagttccttctttaaaagataacatagatgattttcatacaccatctgagcaatgcacatctgtattctcatataatttatcattgacaacaacctttaccggcatataccatgatgttgaatcagataccttacctccatacgtataatattgatctacaacctcaacagttacataccctgacgcaggcatttcatatacatactcttgtgatgtgcctcctggcaacgccatctcataccaattatttgcatttactacaattgattctgccttaacctgcattggcatcagaaagccagataacaacattgcacctgccaatatcaaacttgctatttttttcatcataatttcctttttattattctatatatttctacccttctacacattttaaattttccaccaaaaaataatatacctttttaaaatcaggtatttgcatatataaatcatagtattctttacgaataattttatctttaatcgcaaagcgaaccggacgatccggtttcaacactgcggaaattgcttcaaattgtactttatctgcataaaactcttgtatctcatctttttttgcccaacattttttcctaatctctgcatattcaggttgcattactaccatcttgaagttttcagcatctttcgtcagtgtatcatatgatttttcaacacacttcaaaagtactttttcaattgcgccccttccactcgatggcaacaaatgaagcttacaagtcaactcatgcccatatgctttaattacatctccagtataatcaaaatccctttctttaaatgtcctcgttaaaagagttttaatttcatcttctgtcttttcatcagtatctccaaatagcaaaaatccaccaaattgatcataaacatccaattgatcaattatttcgatcaaagcacttgccttagcagccaaattattacatccattcgcctgtttcaccgctattccgattacatccttataataaaacatcggactatctgttctttttagttctcccaaaccacttggatatattcctatcatatttttaaatatttccggcaattcatctacttttgcaaacgaactaaactgcaaatactgttccaaaaccgcttccaataatgaacaatctgtaacgccctcagctatcaaaatataatattttttaatattcatcgtacatcaaatcctatctcattcctcaaattcaacagtttatttccgctatatctcttagcaatagttttgtcttcgcctttacgaatatgatagatcgcagtatcatccaaatgctccttacaatcttccaataacacatctatcgcttccaaactatgtgttgtcataaataactgcacattatttttttcacaaacctgcataagtgttgaaataaaatttcgaagagctttattgtgtattcccgcttccacctcatcaattagcaagataccatttttcgccaataatgctgacattccaatataaaaagccttatacattccattgccataatcatataatgtcaatggcttcttattttcttctttaaataatttgataatacgatttgttccaattaattcgaaattcgtgatacccggatcaaaaatctgcaaaatttctatcaattgttgtcttaaattattatctagaatattgtccagatcctttaaaaaccggtttgagttatcaaatcttgaaaaagagataaacttacatggaattttcattttaagtgtattttttttcgactctcctattccaaccctgaaattatctcctgtttcttcaaatcgaattttaaaatttcccttcaatgtatcattagaattttcttttccatatgaatagttaaaaaataacgaaagagattcatttatcactccaggttcttttttatcaataacctgttcctgatcaaatgtcaaatgcgtatgcagaatctcctcatctccattccatctggatttcaaacaaataataggattatcaaaatcaattgggaaaagtgactctaacaaatccattgaaaacccatggtatcttgatactaacgcatccaacagtaatcccagatcatcaaacaaacctgacaaaataattgcttccaaaatagatgtcttaccacaattattgggtcccacaaaaatatttactttctttaaatcatctaattctaaatcctttaatcctctatatcctccaacaccaaactcgttcaacatattgaccaccactccatcaacttcataaaaaactaactttccccgatactttcggtaaaaaaacaaattcataaaacaaatgattatttttactagcaaccatactaacattcatagtttattctcatctacttataacctccctactatgtatcttttcattcaaacattatacaaactccacgaaaaactccctaaataaacttatatcatatatgttactacactttaacatccaacgctatattttttctttttttccaaccatattctcctcccattttcttacatctccctctccaaactcaacgtaaccgtccgtatctcacttctacatccctcatccttttcataattcagatctaggaaataatgcaattgatacctatactcacgctctccaataattcctcttattacaatttcgattgtagtctcaatggaaagactcgcctctttttcatatacccattcccttgcctttgggtatgccacatataatacaatcttcccatttatcggaataaattgaaaaaatccatctcccagaatataggcatcattctttatagcatacaaatcatcttctgatgccgtaaataaacgaatctccgtcatatcaatactgcaattaacgatttcgccccggccaacattctctaattcgatttgttgactgcaaaattccatatcgttatcatcaaacaacggatgtccaaacaaatatgtgatttcactacacaaaatcgttttctctgcgtatgaaacaatacgttctgttaaaacaggcatatattgaagtgtcagatcctctcttctttgtctgttattggcaacaatcgtaatatatactcctgccaatgtgataccgccaccgataatacttcctgcatatgcaattattgtactcgcaaatgccgtattgtcaaaatatgctccaatcccccatacaatcatcggaaaaatgcaaagacctacaacacaaaataccactcctatactaactatattcttttttgaatccacaatcaccttctgatcttcatctcctgatgcattctgtgcttcaccatatacacattgctcggccaggtaatatttgtaatcgttgcatactctgtcatataaataatcaacagctattttttctgccactttaggtatatatgctcccaaatattgaattaccaaaaagccgataaaaaataatgtaacccatcgagagtctacatcatgcacacctggatatatgtatgtaatcaaagaaaatagtatcgtgagcaaaaatgctaccgttttattaattatctttgataacaaatacccccaagatttactataatctcttttaaacaattcaatacatttttccttacaatacaaatttttcggatgccatttatcattaaacgtcttatcaattgcctgtaagcttttttctaacaatttctttttataatctttgcatacattttttgactcaccaatcgccaaaataatacccgctattatataagctgcaagttccacatacaccaaatgtatgcttgccttctcaattacaatgtacaaaaaatttaaaagcaatccaaccatagaaaaaaataatgcccctgccaataacgcagtatatagtcttgatttctttatcggtgcgctctcattatagtattcataatatttatctctaaatttttttctaaaatctctcttttgtattttcaaaatgccttctttctgctcaaacctctttaatctgctctatcagttcagcttcgtctactctctctggcagatagtcaataaactgtcctcttccagtaatcaaataccgataccatccatacaaacaatatttataactgtcatccaaagcataaagcttagaatatttcccaacataattatttccggcattccattcttcaatatataccggatacagataagctctctcttcatctgaaataatccttgcatagccattcccatcaataacaagcctgttatgatgcctgtcatctgcattcctcatcagagtctcaatctcagtttttgtaaataaatgctctggagttccatctcttcctatgctgatttcaaaatactgatgataatcctctatttcttcaagtcctgccttgctcagataatcctcaaaaatcctgttgatgttttccaaaattgttatagcctgcttacgatcatgcacaacagcacactccctcaaatcatcagttgaaatttctttaataaaaccatcatggcatatacatctacgttcattgtttatcatttcaaacagattccctgtaaatgatctggtaaactcaaaaaagaagtctataggttctgtctgaacattaccagacacggaaaatgcatcagagaaatcccactctgtgtaattttcttttatatatgcatgttttttaacaatcagattttcctctgcgtgtgctcttttgacttcctcatcatcactctcttcgccctcatcgtaagcagatatttcaaaaggatttttattaaacaatggaattcttaatatcctgtcatctaattcttcctttgacaaatctgtatatctttcatcatgtgctgctctctcatttattgccagatacattttcatcagatactctgtatactctctgaactcatcattagataccataccatgacgtccatcataagtgccggatattccattataaggtccttttttcaaggcaaacaggaacactccatccagataccttttcaaaagatggtacccctccggcagtggttctcccgaatcataatcatatactccatactgggcgcaagaagcgtccacataatgtcccggtgtatcttcaactaaatactcataatctatgtaatcatatcttccaataaccggtgacagattctgcaaatccaggcgaaagtaactccatctgtaatcttctgtaaagctttcataatataaagcctttggttttacgagatagcacatccccgtcgtatcgtaaagatagatacaattctcttctgatgctctcttggcatatgcaaaatctgttccaccacgatccgacaacaacatatgattgtatgccggtgtgctgcctacaatattcaaaacatcaatgattgcatcaacctctctccatatagaagatcccggcacatttttcccgaacagttgctttgtcaaaaacttccagtcactattttgggatttatcaaaatcatctgctacctcacgccaaagtaaaagcttcttagtaaattcatggatatccggtcttaaatccggattattttctgttgcatctttcaacagttcatcaatttcaaccaaatgttcctttttaaatctagacacatacctcaggctatggctctgatccagataatcataaactccatcaaatcccttttcatcgtcactcagaaacatccacagtgttttcgcaagagaaaatacatcagctttacttgcatccgccagttttggatttctcttcatctctggtgcaatcgtaaatatcgcacccaaccctctgtccgacttggtgaaatcatcattatcttggaaatccaccagcccaaaatctccaaacgaaaatcttccatcataataataaatattgcttggcttaatatccctatgatgtatccctttttcatgcaatcttccaagtgtctcacacagctgcaaaactccatcgatgatttcatcaagagacattccatttacgcaacccattatctgctgtgcaatcggcattgtataccagtaatcttccatagaataatctattactggaataataccaggtattatagtacagttatctctagcaatctgaatctcactgacaaatctggactttttttcttcacttctattgctactacgaagttcttttaatgcatatctttttcctgacctgctgtcctccacaaggtagacatctgcattgccgccttctcctaatttactaatttctgtatataataaagtccatttctttgctttcagcttactcataagccccctctccccaacacaaatccttccatatttttctttaattatactaactaacaaacattcttgcaatatttattatattctatttcaacatttaaaattgtagagcttaatttcaattatcacatgaacaaagaaattcactttttcttttccagtttgcatttttgtcgttcaaattcacacttcattgcacttttgtttaattcgtgatactatacatacagttttattgttgtggtgactttattgtaccaaagatcaggtgcttttttatgtcaatacacgaatttattcaattattttgcttgaaaatcaagtgttcaccccagatttactggttggaaagttgagtccctaattttaaaaatcatcttttatcctgtataaactccacgccgaaccactctggatgccgactcaaaatatcgaagcaatatcatatgggttacttccgtaatgtttgcattggtacaaattcaattttcaattgcattcccataccgcgagcaagacgttgcagaagttttaaagatggatttctggctccattttcaagtttgcttatatctgcctgatcaattcctgtgcgttttgcaagttctttctgtgttaaattctgttcaatacgagcatcaatcatagcacgaataacgtccatttctggctgaatatcatcccattcctttttaaatagcttcctgtataattcaaagtgtagatgagatgtaagttgatttacaaaaatagataccttagctaaactgtcattactgacctcagtttcgcgttgttaagatcaaaacagccggaatttctaaaacaggaaatctattcccgcctgattctgtacaatttcggcatctttatcgcaaacgaagcggcagaagaaaaccggaaaaagaaacgggatggtagcaataagtatctctatgaacttgacttttcttcagcattaaaaacagccagaaagttcttcatgcgcagggattccggcaggcacatcgatattatccggctgatgatgaaatatgtccacgcagtgaaagacaggttctggcagtttcaacggcctctccgtggaatcagcgcaattcattttggatatcggtaagttctgcaactgaatatccttctttttgccagatggacagcatctgtctttttggcatacctgtttttggctttttgagtttaaaatatcggatatttgacaacaactgagctatcgaacaaaacttcgaacaactggcttaatggcattgccttttactccattaatcatataataacaaaaatgacggaaacccaatcgcttaacgccaacactccacttgaaaacatctattctatcattatttataaacttttattcataagcccatatattcctcatatgtaatagattttctcgttttcttcacaaaaacacgaatgtgtgatttttgaatgctggcatcagtaatcacccctacattatcctcatcaaactcaaccatatctaaaatagaatttgaaaaatctgttccagctaaacctgttcctctaaaagtaacatcctgcaaaatagcatatcgaaaatttgtgttttcaaatcttccattggtaaattgtgttctagaaatttcacaccctctaaaatcacaatttctaagatcagatccttcaaatctacaattttcaataatagaaaacaagaaatacatcccattcaaatttgagtttataaaattcatacaagttatttttgtacctatcataatgttatttcttatattaattatattaacattatctcttttaaaccccaaaatcttcaaattgatttcttctgttaacgaacctgtaaaatagatcccgtccaataaacgtggtttcaaatatccctgttgttctatattaacaatctcattaccaatattacgcacctgcataattggcaattctatttcacgatcatctataaaatacttatctcatattttgcttactaccgcacaaaatttaaatatattaaaaaacataattgcttgaacttttaacaactctaatttctctcttttgttacaacatccaccattgtatatagcaaaaacaatgtactcagaaagaaaccgcctataaacatccgagccaatatatgattgatcttctaatttaataaaaagatgttcatatacttcctcttccatatctcttatacaaaaaagattacacataagcctatatttttcatcttctgacttattatcaaagtatatttcagttagtctatttcctatatattctgccaaaaaatattcataaaatgatttatgtataaaactgatttttttatctactctttcgtaaaaattattatataagtagcactgtatgcttctttctgtatatttagactcctttatttgggattctatgtcggattgagcaatcattaatgtattctttaataacatctcataagcaatctcctaagcaattgcatggaatgattctttatcttctatagtgaattttttccctacaatatcatatccaccgtctccggtattacatttatcgtaaataccattttgtattgaaaagattttttgatatagcctatatttatcgtgttcattcatcaaatctatatttaatgaatatactatataaagtaatagaggtattcccaaaactgtcttttcctgttgtaatactcgaagtctctctaaagatatcatttcttttgtatatttataatgaaaatctatcatttgcatcaatccaaaatgcataatttgtattatgtaacattgcgcataatatggtctatattttacagcttcaatatctacataattgtccctgacagtaacaaaaacctttatatttatacataaatttttaatgtcattaataaaatttattaacaaactttctgcatcatttgtaaagttaatctcgtctaatccgtctaaaaccaagaatttgttttctaaatattcttcttccacattcaaatacttacataccgattctaataagctatcagccttcgtgagttttgacaatcttacaaaaatatgttttttgttataatcaaaatattttccagctaaatacgataccaaactactttttccgcttcccggaagtcctaaaatgagtgaaatctttttatcagagtttacgtatcgatttaatatttcttttaaattactgtatgtttttatatctgacttataatgtcgtaatgcatgctctggtatatcttcttctggataatcatttagatattgaattacatattcttcattttgtggttttgccattaaaattttcttttgttgttcgttgtactttataccagttctactctttttaaatatattaactactctaaaatttgtttcaacaaatatatccgctaattttttatcattgccatcttccataaataacgatgatttccataattttatatacctgtcataatcgtcattaatttgtaaattttcatctacatatctgctttttggttcagataaactagaataatttcggatttctcgtcttaattcttgaattcctaaaattatttcattatccttagataacaaaattttatgttctggggaaacaaaattatttatttcatcttccaatcttttcataatataatttaagtttcgtttggtttcatttgttataattattccatatttatttttgaattctgtctctacctcgcattcatctatttcatttttaccccaaaatttgacacaatatttatctaaaaaatattggaaaaagcattcccgtaaatattcatttggttctttctctattatatttttaatttcatcccaaattacgtctagatctttttgtgttttcaattcctaaaatgaaattttaaattccactgccctacagggcggtagaatttagtcctgcacagtagatatttactctttcatacatcagtgttattgtaaaagttccttctgacagcagtagaaggagaattatcatgagtaaatatatccctggaaaccagaaacatctaacacttaatgaccgtatctacatcgaaaacgaattatccaaaggtgcgacttttaaagacattgcggcattcctttgtaaagatcctacaaccatctcaaaagaggttaaatcacgacgcctttctgactggtaccacaaaggaactttctacaatgccaaaaacttttgtgtacaccgctatcactgtaaaaaaacaaatgcctgtggaaaaatcatgctctgcggtattaaatgtacatcctgtccaacctgcaaccaaacctgtaaggatttcgaaaaggaacggtgctgcagacttgataaggcgccttatgtatgtaatggctgtccaatgaaaatcaatcattgtaccattgcccataaataccgctatgatgcccgttttgccgaccgtaagtaccgcgaattattaagtagttcccgtgccgggataaatatgacccggcatcagctgcaccaaaaagaccagattgttactccgttgatcgcacagggacagtcaccctatcagatcctgatcaatcatccggaactggatatgtctgtccgctccatgtacacatacatcgataagggactgttcacagccagaaatgtagatctgaaaaggcaggcaaaattcaaaccaagaaagtgccacaaaacacagatcaaagaccgcgaagtatttaccaacagaacctatgcagacttctgttctttggaattaaattcttatgtacaaatggacacagtaaagtcatcaagggactcccagaaaacgctgttaaccatgatctttacagaggaaaaactgtttcttgcatttcttattaaccggtgcacaaaaggtgccgtccgtgctgtatttgaccgtttggaaaaacgtatgggaacgtatgaatttacatctgtttttgaaaatatcttaaccgaccgtggctctgaatttgggaacccagaagaattagaaactggaattaccggcatacaaagaagcagcatttattactgtgatccaatgcgtagcggacaaaaaggaaccatcgaacaggcgcataccatgctccgcatgatattgcctaaaggaacatcctttgaatttctaacccaatgggatgtcaatcttattgtgaatcacataaactctactccaagagaaagccttgacggcaaaacgccgtatgatgctgccctggaaacacttggagaagatgttcttaaagcctttcagctcaagccggtttcaccagatgaagtcaatttaacgcctaagctgatacgctttaagaagtaactaattaactgatcgaaatctgctgtcagactggaagtaaacatttcacattttttaaatgtggctggtggaatttagtctgacacaccgaattccagtagcctgtttttcatgccataaaaacaacaaaatttcgataagctagcttaattataacagaaagcaagagattttgttaaaaaaactcctgcaaaatcagcaaaatttaaaagccgatggaatttactcttgcactggaatttactttttcaagtcagctgtgttttcaattcttcatatttttctttaccaactaatttaattatttgcacaaaaattttcttaagttcttctgatatttctatgtacatgctctttcccccgccttaaatgatagcctctaaccttaatccgtgaaccttgtttcaaaatgaaaaggcacacaggaaatgtttgccatatttgttatcgtacactaaattttgaaaatgctgcataattttgcgttcaaaaaacagactgcaccatttgtgtgcagctgccattgccatattcagctgcctgttgtcaggtgatgaatgcaaagctgtcataaagacgcttgaaagtaaatctccagcgattactcctcccaatggacagtaccagacggccggcatgttctgttagatgtcccgcaaactgcataagattactgatcaccgtacgtattcttcggcgatgtattttcttccggccgggagcatccttctttttcaacgattcctgccctatgattcgaaggatattatatgcgaccattgtcagctccagcaccagtttgttgctcccaaactttcccgacgggagtctttcaacatccatgtccgtcttgatttcactgtgatactgctcactttctccgtgggcatggtaaagatcaatgacggtttcgtctggcagggaagtgtttgtccagtatgtgcccagttctatatcgggtacgataaaatactgcccatatcggtcaatggttctttccgtgatctcataaactgtgcgtattccgacagttttctcctcgttatcagaaagggaatatgtcacatcccggaaggtctgtccggtataaacagttttcccatcacgtggatgctggatattcttgcagcattccctgacggattccagccattcttctttactttcctgtctgggattccgttttatgatgaaagacacattgttgtatttatagctttcttccataaagatgcctatgttttcagatgcatcgttgccggaatccagccggatgagcagtggtttttccgtcagctgtctgcacagttcaatggtctctctcaggaaatcaggaatttctttctggcagtgctgtttcccaatccgcaattcaagattgacgaggtatccttccgtgccgatatatgccataattggtgcatatccgtcaaaacccttgtaggtacgggatacgccttccttattggatttcgaattgtcaaagggggttacatcaatatcgacaggaacaatccgttatccagggctgtcggctctatgtgcatttcacgcagcacgtctccattttttatctgtttctgcagataatcttttgaaattggagcacggttgattttttaacaaaactgctttttccaagtatttgccctatgaataccagaccactgggagtaatgagccgctcatcgctgaattcaatgtgtattttcttcattgcactgcctccgcctgtcttttgatactttcattatacaggataatgcatgatgatacagtaaaaaaacaaaattttgtttaacctggtgggtgaaataaaatgtattgcgaaaatcggtttccagcaggtattattgccgaaaaaacgggatgtaacactatggtaagtttcacggaataaggtctaaaactatcgttttcattgttctaaaatcctttaaaaccttgatatactggaggtttgcaaataaaaattatacgatccacattcattaccacaatagacagcacaatagaacttctggtattcccaccttcaacatcctcttctgttggattaccaccacccggcaggcacatcgatattatccggctgatgatgaaatatgttcacgcagtgaaagacaggttccggcagtttcaacggcctctccgtggaatcagcgcaattcattttggatattggtaagttctgcaactgaatatccttcttttgggcagatggacagcatctgtctttttggcatacctgtttctggctttttgagttcaaaataccagatatttgacaacaactgagctatcgaacaaaacttcgaacaactggcttaatggcattgcctcttgcactcatttattctacccaaatctattatattgttaaaacgctttttttatagtatttctcacattattttttccaccatgccctttatcgcttggggtactggcataaatgattgtatatcgatcatctccgtaatattttactttctgatggtctgactgatcaaaaatgaaaccaatatcttctaagcctttccttaatttttgtgtcataccactatagttgctgagtaatcgctttgcctcttctgctctttgttctcctatagcctcatagttattaacattcaaaatatccgacaatacatcatatcttcttgttcttacttccgtggcagacaattctttcttcacagcagacaatacgaaatcctttgcttctccaggataaaaatcatcctcatccccagcaattaaaacaggaacatctgtcatagaatccaatttagcccttaaccagcttatttcatattctttcttttgaagttcagaagttagtctctcaatttcaaagtttttcttctgcatatctccttcaaagccatcaagaatcctatccgcttctgcttttgcctcttctaaagcctgtttacgcatactctctttcgtttgatccaaatctgacttaagagtaagtaactcataaagtgcctttcttcttccagcttctgcttcagcattttcttcacgtttacaagccaaccgatcctgcaatattgcattatttactccaaaccatgtataaagtgatcctaccatctgcgaattactgtattgcataaccgttctcgtcactttatcataaagaaggcgatcaataccttcggacattctgtacagatatctcctatgcccaattgcagggtttgggtgatatattccaatagcaccatagtattcattgttgccgttacataattctttcaatttacgatttgtacaatttgtcttttgtactaaaacatgagctacaccttttaattcctttgctagtttaccagcatctaccgggtcctcatcataaaaagttttcgtgataattacaactggtaatttgtaccttgcagttccattaataacattaacaatcaaatcgagattttcttcatcgataattagtggtgtcctctgtacttcgagattaccatccttcaaaatataaccacgatcaattaacagggaaataaaaaatggagtaaagaattttgtatcaacatttaatgcctcttctatataactacgatctaatcttactgccatcttcatttcagaaaaattcataatataatctgtgtcccatatagccccatccgactctctcttttcaaatcgaaccgcaattatatttttgttccggtattcttgaatctcaagacatttattctcatcctcaaagcgaatatttctttctccattccactcaatgtttgatataatggttccactcaattactaaatttataaaatcatcttttgtcagttttttgtcaatttcaaggatagttgaaaataataacattatcgtccctctttatctctggtaaaatttttgatgttataacaagtagatgctattacagccattcgatatttataataacttacgcccttgctcttttactatactcttccaaatggataaccttgtctttttcttctcgttcaatatctgacttctttaaaatctttaaagcacaagtctctctatttttttctcccaatatcccatttctcagcaaaatatggataaaccttatcatcggtaaactgcttcaatactggtaatgcaattgaaaagattaacgaatctaccacatcgaccaagagaccaagaatcttactccctccattttatatagattgctaccgcttacttctttttaggcatttctataaaatcttctcaacgatattttatttacataatactctcgctcatatcgtttatcaagcactttatgtacaaatgacaattcgcgtttcaattcctcataaagcataacatagcaagaaaaatatataacagacaagccgacgcaccagcgccggctctccttaccatctcactattctactccgctgcaagcccttcctcccggatcacctgcaccatctcatccacatacttcgcacaaagctcatcactctgtgcctcaaccatcacacggatcaccggctccgtaccgctctcacgcaaaaggattcttccatcctcccccagcgcagcggtaatacgctctttttcttcctgcacatgtgcatttcctgtaactgccgccttgttctccacctttacattctgcaaaagctgcggatacatctgcattcccttacacaacatgccgaggctctgcttcttctccaggatcacctccatcagcatcaatgccgtaagaattccatctccggttgttgcatgcttactgaaaatgatatgtccggactgctctccaccgagcacatatccgttggcaaccatcgcctcattgacatacttatcgccgaccgtggtcacacatacctcgatgccctcgcgcttcattgctttgaacagtcccatgttggacatgatcgtggcaaccaccgtattattctgctgacggccacattccttcagatacttcccacagacatacaggatataatccccgtgcacttccataccgttctcatccacggcaatacaccggtccgcatcccatattgatgttggtaccgtccggctcattgccaaccacatatgttttggtaccaagcgcatcaaacacactctttgcaatattaaacgtacttccgttggaacaatccagccccacgcgcatcccatcgtaagatcggtagacagataaatcacggactacatatgccacacttggcgtagtggtaatatgcagcaaaaatgcctctgctccggatgccgtaatatcggcaaacagtaccccattaaaaaagtttatatttttttaatggggtcagaccccttttatttcctggttgaaatgcaacaatatcaaagaaatttcttactattactggttgcataagtttcgcaaagaatcatacgaccaaatgcagagccttgccctgttcctcctacttgaattacatttcttctagtagtttctgtgcttttctcttattctctaataaattatttactgcttttgttggtgcaactccgacaagttatcttccccaaaaatatactaacaattttctatatcttcaccataaataatgtttcttaaatatatccatgccgacatctattaattgtatattatcattatcaataggaataggacacaatagcaatttaccaccaattttttctaataattgtattaatgctttcaattgtttttgtgaaactcctcttactacccatctatctttatctggtaattttcttctcagttcctcagctgtttgtcttgaaattaacataggaacctcatttttatcagatactgagtaatacgttcctgttacttctccatcttcttgaatctccattaatgtccaaaatggctccccacataccttctcatctggcaaaaaaactttcttaatttttccagcaagtatttcattaaaagatggtaaatcatttttattcatcaaaataattcctcgtcccttcgcccactcaacagcaccagactgataaccgcttgttgatatcattacagcagcaacattgcttaagcgttcaacttttgaataaaaatctcttacttcttttgctgttacaggtttattccaatctttacattctatggctactttatacgttaaattgaggtgttgaaattcatagtaaacatctatttctccttccaaaccatctacccctttaatctttgcgcgcttacacacaacgctctgacaatcattaaggttcaataaagattgatatacatatgcaacaaaatcctcaaattttgcaccttttttcttccacaattccatacatacctcctcatgccaaatcattattctttagccataatcataatgctatttcaaccaaaagcaataacaatcttcatttatataatccacttcttcatacttcatattgccacctcatcttcatataaaaccgtatactaattcaggatactacaacaattaacaaatgaatatattatcgttttacattttcttttctatatttatacaatacgctcctccatatcatttatcaagtatttttcatcaaaatgacaattcgcacacatcaccaaattaacttattaaagtttatctatataaaagaagccgatttccacaccggcttctgatttctactctctacaacaactcctcccgtccatcttccttcaacttatcaacaatcagcttcacatcctgcgcccggttcttatcacacaccaatatcgcatcctctgtctcaacaataatcaggttatccacacctatcgttgtaatcaggtgcttcttagaatatgtaatacaatcctttgtatcaattgtcagatgatttccagctacaaaatttccattggcatccgtatcatgaagcaccccaaggttgtcccagcttccgacatcactccatcccatatccgcagaaataactttcacaatatcactcttttccatgattccataatcaatagaaatacttggaataaccggataaatttcattgattgcttccatctctgagtcagttcccatcgcgtccccaattttcaccagacacgcatacacctctggaagaaattctttaaactgttccaaaatcacagaagctttccatacaaacatgccactgttccatgcatattctccacttgcaacatacttctccgctgtcgcaagatccggcttttccttaaattcgattaccttttttgcaataccttcttctcatttgtcaaaccgaatatatccatatccggtgcaaggataagtcagtgtgattcccattgtaacaagaaatccaccctcagcaacctcaattgcctctttcacaaaaatgctaattatcaatagtttgacattttctttgacaacatctgggctatcaaacaaagctgtgtacaactggcttcaatggcattggcttttgtttaggcacctcttttttgtaatcctaaataatcacttggcttaattgcctttatatttgatacagaataatccgatacatttcttgtcacaatatattctgccccataactctttgcgcattccatctgtagacaatcctcaaaatcagaaaaattatcatttacgagaccaaataatagttttatcttatctataccctctacatcaaagatttcgcatagattgaataatatttccctgcgttcctcagttgtataatcttttcttaatatgtaaaacatattagatattgaatgtgctgcaatacatccttttatttttcctttgatgcataacaaaatcacattctttgcgtcctcaaagaatggttctctttccaaaagataatcgagtaatacattagtatcaatcaaaattttacctgccatatttttcttccctataagaagctaactctgccttatcatctgtaacagtacccttttttcgtaactgttccaatcgttcaaacgcttctttcctctccttatctgtatcattatataatccatttacgccttgcataatctgtattacaaaagacaatttatcttccggtatcttttccaattccaatattgcactccgtcttaatgctgtcatagatccatcccccttcgagatttcaaataacctaatatatatttatcaaaatagtaataaagccccttatccgcttttggaaactacttcttttctatattatatctattatttccattttccacaactaaattttctaagccattctatctccggcaaacattttcatcattttttgcatatttttcattttcaaatttccagtatcagatattttcccgtacatttgttctatttttgtgtcccgtttatgatcgctttctcgtcaactatacccctatatatttattttgctattatattgttgaacaacaccgttggaaacccaaaatttaccacatttaatagacttactttatttatgccatatcacatatacaacaccttatgtccgtatttatcaccataatctgctgttataaatgcaccactgccttttccagcaccaataacaacgatttcatccgaccatgcacttataagacgattgcgctgcggaaatcggtatcttgctggtatagttcccggtggatattccgataataataaccccttattttgtattttctgcatcaacttatcgtgttcacttggataacatatgtcaaggccattgccaacaattgctactgtataaccatcattattgattgcaacagtatgtgcatatgaatctactccttttgccataccacttataatactgtacccttttgaaacatactgacttgtaatcttaattacttgtttctttgtctcttgtgtacatcttcttgccccaacaatccctaccgcacgtttttttctttctggcgttcccttataatacaaaacaatcggtgcatcatcgaaatattttgccctgtctggataacatgtatctgcttttgtcattatagatatccctaaagtcctgcaattatttataattgtctccgccaacaccatgtcatgattttctactatgttccttaactgtcttttattcaatattcctgtttgccgcaatgtgttttcatccgcttcgaacaccacctgcgggtcacccatacaatccattaatttgtttgctgtaaccactccgatatacggaatttgtgtcaaccataaccaatacttcaacttcatttaacttaccaccagcatcttactattgcttttatcaaggtctctgcatgacagcactctttcaatatccaactgtcgaatcctctcctctccatctaaatctgcacttgtccgcgctaaacgcaacaacttgtgtattactcttgcgctatatccatatttttcgcttgtctgctttaacagttttaatgattcttcatctaacacacaaaattgctgaatgagtgatgtcgacatctgggcattacaattaatacctttttcatttttatatctctcctgctgaatcatacgcgctttttccaccttttctcgaatccacgcagatgatagagactctttctgattttccagattaaaaaaattcaccggctttacctctttttgtatatcaatccgatccatgataggtccggatatttttcctctgtactttattatctcataatccgtacatctgcactttgaactgggataataaccacaaggacatggattcatagctgtcacaaacataaaattagatggaaaggtatgtgttccgttcactctcgaaatacataccctcttatcttcaattggctgtcttaacgcatctaatgtgcgccttgaaaattctgccagttcatctaaaaacaacactccattatgggctaatgaaacttctcccggcagtgcattcactcctccgccaatcaaagcattcaaggacgcattatgatgtggtgctctaaaaggtctgttctttattagtgaatggccattctcaaggattcctgaaatgctgtatatctttgtgacttcaagacattcttcctctgtcatctgtggcaatattgtaggaattctctgcgctaccattgtttttccacagcccggctccccaatcattaacatattgtggccacctgcggcagcaagcataaccgcctctgtcaattctgcttgtccttttacgtcagaaaaatccatgaccttttcatttctatcatctggcttgataatcaccatttgtttttgctctgcttctatattttttccttctacatactgaatcacttctctcaaatcatgcaaccctatggtctctatcccatgaactaattttgcctcatttatattttcaaatggaacaataagcttttttattttccttttctttgcagctatgatcatgggaaggattcccctgcaggcccgcaatcggccatctaaagacaattcaccaataaacccataatctgaaagactttttgccgcaatatcatcattttgctgtaaaacccctattgccatagccagatcaaaatgagatccacttttctttttatcgcttggtgcaaggcttattatcacacgtttttttggaaaaacatacccggtttcatcaattgctgcctgtaccctctctgctgcttcttttactgcaaggtcacccagcccaataatattaatgagcggttgtccttccagcgtctttatttctatatcaacggtatacccatcaatcccctgtattgcaaaactttttaccacggtagccataattcatcttcccccatcactgttcttatctccgtttctgttaccacatatttatttgctatatcttcaacaaattccctgtatctccatatgcttttgtttccaaaatatgacaatgttttctgactcgttgttattccatcatcacatagattaattattctgcgatatgaactccacttataatcctccggattcgacaccatccttgccttaactggattcaaatgaatatatctgcttgtctgtagaaaatattcatccgtttcaaccagacatgacttatatctatcctcaaacaaatgccctttatatccatatcttctattgaatgttctagcataatctcctgcaagtttctgcatgatcttaccaactttctcctcatatgtctccaataacagatgaatatggttcgtcatcaaacaatatgcatgcaggtttgctccatatttttccattacattctttaatattgcaataaatatatagtaatccgtttcttctctaaaaatctcctgtctgcggattcctctttccattaaatgataaattgctcctggataccattctctttcttttcttccgattttttcataccccttgtttcataatttatccgtttatgcgtattcttgcgcaaaaatttaatccttcagtgcatccatataccccagtaatcttttctgctgttctacgcttaattgctgatatgtctctatgagcatccccagttccgtatcctttgtaaatacatacatttcatttgttttacttctggttcctgtatgctccgctcctgacaagagttcatacggtgtgacacctaatacctcacatataatcaatatcttatcgctaaccggatttgttcgtttcttcttccagtcacttatagaactttctgctatccctgtcctctgggcaaattctttctgactcatacctttttcttttaataattcaaatatcttatcgcttatcgtcttcattttatttttccttcatctatatttattctcaacgtccttttccttgcattttatcatatttcaaccaattcgtatacacgtatttattattttataaaaattttattgtgtcaggcacctcttgcagcttatgggaaacgatcagctacttccggcatacaacctacaggcagccatctgtgatgaatacatagctgtaatcgacgtaaaaccatatgcatccgatatggaatgctttgttcctttgatggaaaaattcaatcgcacatatggtcactatccgaaatatccggttgctgatgccggatacggttcttacaataattatctttattgtgaagaacacggcatggaaaaatacatgaaatttaccatgtacaaaaaagaaacgacggacaaaaagtatcatgagaatccgtatcgtgctgtaaactttgcaaaagatgcagatggaaatcttttatgcccaaacggtcgaaaattcctcttcaagagaacacagcatgtgaaatataataaatatggaagaacggaagaattatacgaatgtgaatcttgtgaagggtgtcagcataaacaggaatgttgtccgagaacacacaaaaaccgaacgatccgaatgaatcaggaattaactgctatccatcaggaagtgctgcaaaatcttgaatccatacatggtgctctcttgagaatgaaccgaagtattcaatcggagggaacttttggtgtattaaagtgggataaagcgtataaaagattattgcgaagaggcgagaaaaatgtaattctcgagcttacactgatttcatgtggattcaatctttataaatatcacaacaaaaagcaacgacagacgaaagttgcataaaacttaagcgggcgtgattagccgagctttattaaatgcaccattttttatacccaaagatgcagacttgcttagaaatagaaaagttaatacaaagaaacgccaaaaccgacatttgccggaattggcgtttcttatattagggacttattttacagcccctccccttaccatctcactattccattctactccaccgcaagcccttcctcccggatcacctgcaccatctcatccacatacttcgcgcacaactcatcactctgtgcctcaaccatcacacgaatcaccggctccgtaccgctctcacgcaaaaggattcttccatcctctcccaaagcagcactgatccgctccttttccgcctgcacatgcgcgttaccggtaaccgcagctttgtcctcaacctttacattcttcaaaagctgtgggtacatctgcatccccttgcacagcgtgccgaggctctgcttcttctccagaatcacctccatcagcatcaatgcggtaaggattccatctccggtcgttgcatgcttactgaaaatgatatgcccggactgctctccgccgagcacatatccgttggcaaccatcgcctcattgacatacttatcgccaaccgtggtcacacatacctcaatgccctcgcgcttcattgctttgaacaatcccatgttggacatgatcgtggcaaccaccgtattattctgcagacggccacattccttcagatacttcccgcagacatacaggatataatccccgtgcacttccataccgttctcatccacggcaatacaccgatccgcatctccgtcaaacgcaaatccgcaatccagattcttctcccggacaagtctctgcagattcccgatatgtgtcgatccacatcccatattgatgttggtaccgtccggctcattaccaaccacatatgttttggctcctagcgcatcaaacacactctttgcaatattaaatgtacttccgttggagcaatccagccccacacgcatcccatcgtaagatctggtagccagagaaatcagatagccgatgtaacggttccgtccgatcgcataatcccgcgccacaccaaccttgtcacgcagtgcaaaaggcagttctcccatctcaccatctatgtatttctccagtgcagcttccacttctgcggaaatcttgtgtccatttccatccatgaccttgattccattgtcataatatggattgtgactggcagaaaccataatgccacagtcgaaattttccgtgcggactacatatgccacacttggcgtagtggtaacatgcagcaagaatgcatctgctccggatgccgtaataccggcaaccaacgcatactcaaacatataactgctgcgacgcgtatcctttccgataatgatccgtcccctgtgattctggttgtaataccagcccaggtaacgtccaattttatatgcatgatccgcagtcagtactttgtttgcctcaccgcgaaaaccgtctgttccaaaatattttcccatgacaacctttaactctatatatgtactaattacattaaattattttaaccaatatttctttcgtagcttttattcttaccctatcctaatgcataaaccacgattccaacaataatcaatgccaatgctattattttcttagaatttaatttttctttaaaaattttcactccaaaaaatgtaacataaatataacttgtagcctccaaaatcggtcccattgataacggaattcctttatatgcaataattgataaaaatgttgttccaacaaacattatgtatgcaatgataaccagcggattcatatattctttgattttagactcatactgtttcattgctgatttttttaacatcacctgtgaaattgcactcacaaaaacaccaagcaacaacacacaggaataaattacaacagtcttattcatcttttactttcccatctgcatttgcataaacaacaactccaagaataaccagaattgcaccaattacttttccaatcgtaactttttcctgaaaaaacacagctccccatataattccccatacaacggtaactgccttattcgcaaaagctgttgtcagaggcaatcgtttgataatctgttgccagccaattgcataaaaaccaagcaataaaattataatcgcataataaagacaaaaatgcggacttaaaaatttttcgccagatgcaagtttactgcaaatcccactcatcgaataaatcatcagcataatatgcaataaaaataatacctttaattttgatttatccacgtttactcctcctgtggtaatggtaaatatttcttcaaatcttcataacttgaagctttcatcagaaatgccccatatcggcttgaactatccacaatagcatccgttccttcttcggttccttctgttctcactaaatactccggatgttctaccctcaacttattcaatatatctgcatcttctttaccgaaaatataatgaattgcggccgcccccgctctatgataatcagataaatccggtttttctccaagagcaacattaattactgctttaacaaaatctactcctgttgacaattgtaccaagtcacttccaatacaatctccacccattcgtccaccaatttcaatcaattttatatttccattttgatcaatttttaattcagaatgagatgcactatcagtaatcatcagactatctagtgcgtgaaataccactttttttacattttctaatgtttcttctgaaaccggtgctggctctaaatgtcccgtttcaataaaatgaggtgcaccggttgtaaatttatgtgtcattgccagaaaatgatgttgtccatgaaaagaaatacactcaacactatactcctgtccttctgcaaattcttcaaccaatgctttcttttcaaatccctgcttttttgcagtttctattgcatctgccaacccctctgcattactaagttttgtgattccccgacttcctgagcgatctgtcggtttgacaattacaggatattctaaagttattcctttcagatcctctatagaatcagccaaaatgctttttggagaaggatctccatttttctcaaatgccatgcgcatcaaatgtttgtttgtagaaatttctgcacattccttggagtttcccactaatcccatttcagatgcaacataattgaccgtaatagcagctaggtcacttgcaatactacaaattccatcaataccaatttctctgcatttttttaaaatttcatccttttcaataatactgattggataaaaataatccgcacttttttctcccacatctcctgctgcccaggcaaaaacatgtgtttccaatcccatctgatttgctttttcaattaatggctcctgtaagtacgaagcacctataattgccaattttttcattttgccaccttatttcctgaatcaacaagtacttcccaacgaccactttctaattctttcttataatccttcatcatttccatataatccgtatacttcggtataaagccaaaatctttctttgccttttccatactatataaaaatgacggtgtattattttctttttctggtttatatacaatgtggcttttatgttctttattgccaaatacttcaattactgcttttgcctgatcttctaagtcaagttgtgtgccactcgtcatattataaagaccatatgttttattacccgaaagtgccaacacatacgcatcagcaacatctttcacataaataatgtctctttttatatgaggatttccccataattcaatattttttccttcttttgcattatcaataaacgtagcaattcctgacttatacgcttttccatttacataaattgttccatgtggtccaactccatacactggtggaaaacgaaaccaagcacattgcatgccatgttgttgattatagtattccattacatcattacacgcatttttactaattacataaacggcatgatctcctttaaacttgaaattccttggttcatcctccgtaatggaatatccttttccccatgccccagacacatcactataactacagtttccaataactttttttattttattttttctgcagtattctaagacattaattgcaccaattacattaatcttaaagtaatctgctgcattttcatttgcctccaagtctgcctttgcattcgcaggcaataaaccagcaagcaaaataactcctgatacattctccgttggaagttttgaaaaatcttctttttgagtaatatcaagttctacaaattttgctcccatttcttctaatttttttccaagaagtttatttctacctgttgcaacaacatcttcgcccttttttaaaaaagcttccgttgtatacatgccaataaaccctgttgcacctataataactaccatttttaactcctatttttctttagcatttaaacattcatcaatcacatataatggacgattctttgcttcattaaaaatgtttccgacatatattccgacaactccaattgcacatagaataataccacccatcaaataaatcgaagctacaatacttgtccagccaacaagaacatctcccaagataatttccctaaaaacaagatatattatataaatcaaagctagaaatgcacttacaaatcccaattttacagaaaaaagcaaaggtttatttgattgtgaagtaataatttcaaatgccatcttcaattttcgtttcaaattataagaggatttaccttcaaaccgctcatctgccggcatatcaattgccgtctgtttaaaccccaaccagcgaataaacattgtatatgcgcgattctgttctctcattctacaatagtaatcaattacttttctttttgaaatactaaaattacaaattgaactgtcaaaagttccgtctgtaaaataatcatataccttataaaaacatttagataaaaattttgtaattgcactatcttttcttccttctcttcgtgcaaaaactacatcatatccttcctgtgctttttgatataattctggaattgtctcgggacgatcctgtaaatcacaatccattacaacaacccaatctcctctacttttatctaatcctgctgtaattgcacgaatttgcccaaagttgcgagccatatgaattccaataacccttttatctttttcacaaactttttgaatttcttcccatgaattctgcgggcaataatcatctacaaggataatctcaaatgcttttgaaattttttctaaactctcacataatctgcgatgcaattccggtattgcagcccgacatccataaacaggaatcaccactgaaatatcaatttttttcacctgttcttctattttttcactcatttagtataaaactccataatagcatctattactctttccacatcaattttcttcattccataatacaatggaagtctcaacaaacgctcactttctttggttgtatatacatcttctcccacaaactcaccatatttctttcctgctggtgcggtatgtaatggaatataatgaaatactgaattaattccatttgatttcaaataactgatcaactttgttctttcatccaaatcttttgctttaatataaaacatatgcgcattatgattacattcatttggaataaatggcagttgaatttttccactctccgaaagacctcttagtccttcccagtataaattccagctttccattctattattgaaaatttcatctgcgatttcaagctgtgcccataaatatgctgcgtttaattcgcttggaagataagaagatccggcttcaacccatgtatacttgtctatctgtcctctgaaaaatttacttctgtttgttcctttttcccgaacaatttcagccatttcacaattatccttatctcggataactaatgctccaccttcacccatactataatttttcgtctcgtgaaaactatagcatccatagtcgccaatagagccaagtgcccgtcctttatatgtactcattacaccttgcgcagcatcttcaataaccagtagattatgtttttttgctatttccattatagtatccatttcacaagctactcccgcataatgaactggaacaattgcttttgttttttccgtaattgcttcttcaatcaatttttcatccatattcatggtatccggtcgaatatcaacaaattttgcttttgcacctctcaaaacaaatgcatccgctgtagaaacaaaggtataagcaggcataataacttcatctccaggttttatatctgctaaaattgctgccatctccgttgcatgtgtgcaagaagttgttaataaaacctttggtgcaccactccatttttccagccagaagttgcatcttttcgtaaattctccatcgccacttaattttttgttgttgattgcttctcttacataatcaaaggctttttctaccatgattggctcattaaaattaatcatttgttccctttcctattttaataaataaatattatatttttgttctctatctatgcaagaatcaatttccatttggatataattactttcctcatcctctaaacagatctttccttcttgttcattctcacatattaataattttatagtattattatatacataaaaactgttatctttttgcatttgaatatacaaatcaggattttcctcagttttattttcaactaccatacctgaatggtatatatttgcaaactgtgtccaatgatcttcctcgaccgctaatgtattttttgtttcataaagactaggtgcttctattacaatatttccaaattgattccaataatttaattttaacaaattttctatatctacaattctttcataattttgggattgttcttcagcaaaaacattattttcaatctgaataaaaccagatcccatcaataccaaacaaataaaaacaatttttacatatttcttattaaacgctttacatattttccataaaaaatatgtaatagccaacatattagaaaaataaagataaatacttactggaatagagataaatccactattagaaactgcctcttgatataaaggagtcagcgcattaggcaaagccggaagcatcccatatatcaatgcagtacctataatcaaaatatcactctttcctaatttatattttttttcatttttattatttaaaatagtaattaataaataacttaacgcaaccacaaaaacaagaaaagaagatttatacaaattctgaatatgtatttttccatgattataatattcaaataaaaaacgatatttttgattaaatatcgtaaaataacctggaagtgcagataaaaaaacaacttttaacgtactaaatattttcctaaaagaaaatatttttagcgtatttcctaaataattagtaggaaaaattttagcctgcaataaataaaacattaaataaacaatcgcaacacaaaaaagcggaaatgtttttttaattgtattgatcacttttatttttatatttttaatctctttttgatactttagtatatatatgatcgggaaaatcagaacatatgttataataaattcatacaagaacattgcccataggaacattaaagaacataaaataaaatttatatgttttcctttttcaacatagtttataaataaagcaattgaaatttccaataaaattaaaggttgtaaacacacaatcatataagcatttggcactgacagttcaaaagtaattggaagaaatactaaaattaatatacataatactgttgaaaaataaatatcttcaaacaatcgatatacaatacatccaaacaaaaatattgatattagcaaaaaacaaacgcctattgttctaaacacatacttattatctgataaataagataaaaatttcacatttcctatagtagccagaatccgtcctttcaaaatattttcattaataattgtggttctaaaaaaagtttttaatccctgttgtgaccaaagacgtaataaaagttcatcattgcagataattccctgctgtatcattggacaacaaactgtaattatcaagattcccaacataacaaaaacagattttttattttctcttttcaatttacttcactctccccattaattttttattcaaaaaagctttcacacaagtatacattttctttaacaccaatggtaatccaattcccacaatatagtacactggccataaaacaataaaggtatgtgggaaaacacttaaattagtaaaatcatgcactaaaaaacaagccactaaatcaacaatcttaaatgccaaaaaatgtaatgccataatatcaaagctattttttcctatataagcaaatatattcccaattttttcacttttgtcaattacagaactcaaactaatgcaaaaagcaatgcctattatagttacaggataaaaaatatatcgattaattaccatgaattttgataattcgactatgccaatattcatgtgtaaaaccatcgccaataaaaatccgcaaataattgtgctaagtatacccaaatatttttttatgtatgcctcatattttttataaagatgaccaagttctaccacaaataccatgagatatgaaatttgcatattatacaacaatccatattgtttttctgttattactacaccaacaaaaccgataaccaagcaaatgcaaaaacgtacaatgtctgaatataaatcttttaattttcttgtatacataaatatcgctgtatataataacattgtaataaacattaccggcaaaaaccaaaatgctgataaaaattctcccaaactattaaatgtaagaatatttgtcattgaaataacaaaactgccaattgttgtcttttcgccagctaaaattcctaagttaataaaaaaatttctaaaaagcaaaaatgaaactgaatatataacaaatggaaaatataacgcttttatctttttctttaaaaactctccccaatcattctcttctttcttatataaaaagccagagcaaaaaaagaagattgccaaatgatataaatacacaaatggaccgattggaatatctatattaccaattggtatattccagcttgcatgtcctataacaatggaaataattccaattcctttacatatatctataagtttattcctttttatagttttttccactttatcctaccttttatttctattattatatatctttaaactataattacaaacagtccaaaacaaactggtcattaaatatagacgatttttcaacaatccatatgaaatttttcgaaaatatcgcattctcctcccctcccattgaagagactctttaatttcctgattttcccataaatctggaaaatccattctaaccttttccatatacttcttaagcaaatgatatctcaacttaaatttttgtttcctaattggatataatgccattgacaatacctgatgcatatataatgatccttttattttttcagcttttacaggatcaattttattaaactgatctatacacattttcacagtatttaaaatcacaaaacgtttttcactaaattcactgttttgaatagatccttctctctgataataattgtagtatggtttatttataactgaaattttttttgcccttgctaaaacaattggtgtgacagcaacatcttcattatttattccaactggaaattgcattccatcatataattctcgccgtataattttattccatgatgctggcatcatagacatatcaataatcttagagaatacatcatttcttgattcaactgtacaggaccattcggaatctttcaacgaatcatcatatgccaaacgaatgtcacatacaacaatatctgaattctctctttgtgctatttccaacatatcaatatacatttctttttctacataatcgtcagaatccaaaaaaatgacatattctcctgtagctcttttcaacccataatttttaacatctgacagcccaccattttcttttttaaaatatttaataaatgaattacattcacaatatttttgaattattttttctgattcatctgttgatccatcattgatgattaaaatttctacctgatcagttataggtgtcactgcatttatagccgaatctaaacaacgcttcaaatatttttctgtattatatactggaataataattgacaatttaaaatttttagagtccaaatcgaattctctccctttcacgtctttcgtacacttttttaataactgtctccgaaatatcaaaattacttaaagcaaaatcttgcaatcgaacaatttcatcaaattcctgttcatgagaagttgacagtgttaatccttgattttgcattcgatgataattatatgattctttaaaataagcaatttttccattttttaatatattcatataagcataccaatcacccgctaatttaaaagccttagctccctctaaaattttctgatagtctccattttttattacagcactagaaacatttgcaattgtattatttatacacatcgtctcttctacttcttttttcccatcattaacgtaattatcattccatttcccacaagaaaaaatgtcaatccatggacgcaagtttcccattaaaagtttattattttcatccatcgttaaagattcacaataagataaaactacttgcggatcatcaaaccccttcataactgtttccaaaaaacgagcgtctgaactatcatccgcttcagctatccatatatattcagtttttgctacttgaaaagctttttgccactgtgaaaaaacacttccagaatttttttcattttcaataagtcttatgtttatacctgatttattatattttatcttttgcttaataaatttaacactgtcatcactagaacaatcatctaaaattataatttcctttacaggatatgtttgaaacaaaatagaatctattcgttcattcaaaaaacgttcataattgtaattcggtacaactgcggtaacattctttattatcccattatattttgggtagcattcgtttttcccatatatatttatagtattttttgttttgctttcatttaacaaatgaatccttattcttattttattttttattgtttcaggaattggtaatccacgaaacactttttgaataaactttatttctcccatgtacttatctccgctttttcatctacactatttcttccatatttttcctatcagatttttggagttaataactttttcataagcatctacactttttttaaattcgcaatctttttgagcaattactttttcatatgtgtctacactttctttaaattcactgtctttttgagcaattactttttcatatgtatctacgcattcttttaatttttgttctttttctttgactatatctaataattcttgaaaaataggatcatcaaaatcatattttaaaaattcaatctcaacgataatctttttatcattatcttcaagatcaaattcaatctgaggcaaatttttcaaataataaaaatgattttttgtaaaatctgcattattcttatatttttccacctttcgttttcctttgtctgattctatataaatattttttatattaattatgcagttgcaattaataagatctaattgcacacttttgctcttttccaaaacatccaaagtaattgttacattttttaatgccggattaatatagcgacttacacattttctataatcaaatattccctcattatcatatactgcttgtacttgataatgagaatatgcatctaagcaaactcttctctctacctctcccatgagatattccgagcttaacgccaaagtaaacatatattgatacacattgccattctctctctttattaattctttaaaaacttctttagaaacatccccatatgtagattttacctcattttctccaacgcgaatatattttgccttttctccaataactgcccatcccactttttccaccatttttgtgaatgattttcttgtaaaaaactttatatgtgtattatccaacaaaccaattggattatattcaaattcatcattcatcagttcaataataatagaattatgagacacatttggaactgatactaatacttttccttttttctttattactattttacagcgatctaatacatcttccggatgtaacagatgttccaaaacatctgcaaatataacataatcatatttcacgtttggattaatccaatgataattttctatatctccatttacttttccaacatatgccgttctagcatattctgctgcctcattccctgattcctcatcaatttcaacaatatcaactatgcactttttctcaatgcttaagtattttgttaatcttccatttgcagcaccaaattccaaaacatggctttctttttcaatttttcttgctatccaagataaagtattttcctcatatacatcaaattcaaaatcatatttactcaattttacgtctccattcatgtggaattatacaaattccctctccaatatacttagctgtaacacaaaattcttttattttcgcccaataatgtattggcacagaagcagttttatcaaaaagcgctacatcaaaataatattttcctcctaaaactcgaataccttctgagtaaaacaattgaaaataatttcttccatgtttccatgggattttaatttcatctaacattgtatttactccacaaatatatgtttcatcaattctttttaatgcaactcctaataccgggatctctatattttcatcataaacatcataaacaatttcaattctaaccggatcaaatatatcaaattcttctacattttttccttgtctatttaatatacgaattcctattatttctgcaacactatcctgttttccctcacgaaattttttaaattccacctcatttcctgtctctacttctacaatatctctctcatattcatcccctacttttaagaaatcaagatattgatcacaaacataatttgtttctccatatgtttgtatttttccatctctcagccaaactgtttttgtacataaccttctgatagcattaatgtcatgagaaacaaataaaactgttatcccttggtccatcatctgtttcattttatccatgcatttcatttgaaaccttaaatcaccaacactcaacgcttcatctacaattaatatttctggatctacattaatcgcaactgcaaaagctaatctagcaaacattcccgaagaatacgttttaactggctgataaataaaatcccctatatctgcaaattgaataatctcatccaatttatcctccatttcttctctcgaaaaccccatcatagtgccatttaaaaatatattctttattccagtaaattccgggttaaatccagttccaagttctaataacgctgcaacttttccatttacctctagttttcctgatgtaggtgtcaaaacccctgtgatgatttttaacaacgtagacttaccagctccatttgttccaacaattcctacaacgtcacctttttctatctgaaggctcaagttatccaatacacatttttctctactatattttttacccgttaaactaaacacttctttaactcgatcgcttggtttttcgtacaatttataattctttgatactctgcacaattcaattgctatttcactcattttaatttatccttataatacatctgcaaaatgcggtttaagctttttaaaaacaactttacctattatcaataaaagtgatgtaaaaagccaaaaataaactgtaagtaatggtttttggaaaaaccactttccttcaataaaagaatctctatatccttcaacaatataaaatactggatttaacttcacaatccattgaaatttctcaggtacaattatgtatgaccaaatgattggggtaacccacaatcctatctgcaaaacaatatttacaatctgccctagatctttgaaaaatacaataatcgaagaagtgatttttccaattgcataggcaaataatatcaaacacaacatataataaaatacctctataaaatgtaacgtcattttttgtccatttgccaatgaaataattaccagcagccctacaaaaaacaaatgaataaacaagttagatataatttttacaattggcaaaaattcaatatcaaacacaacttttttcaccaaataactatattctataaaactgtttgtaactgcatttactgcatctgaaaagaaaaaccatggaatcattcctgttgcaaaccacacaatatacgacacattaggtataggtgctgtagattttaatccaaattcaaatacgcaccaatatactaaaatagtaataatcggctgtacaaatgcccaaaaaattccaaaataagaaccagcatattttattgcaaaatcattaaccgccaaatcccatatcattgctttattttttctaatacgttcaatcataagtccaattctttcctcgtcatctttcgaaaccatttccactgtttccgaaaatcttcatatttcacacagcggattagataaagtatcacccgataccaatacagcggtaaaattttccactttgatgcgtgcaaatacgctttgcaataataaatctcacttcgaacactatgtgcaaaagaaaatgcccttacatgctgcgtactgcctccgtgtaagtgctcaatcactgctgccggatcatacacggtacgaaacccagctttttccatcgtaattcccaaaatcagttcttcttcatatagaaatggatgttcatccaaaggtgtaaccctctctgcacatgcccgcgtcataagaaaacagcatcccaacacagcatacacctcatacattgtatcataattccggtcaaaaccaaagtatgtcttgtaagaatgtcgaaaaatagcatttaatcgagtcctgaccagatatttttccttcatcccggtctttctgcacaagttgcttttttgtatttttccatcgcgatccaatattttaggtcctacaattccaatctgtggatttttctgtgcacaatcatacagttcctgaatgcatcctctttcaaaacacacatcattgtttgaaatcaagacggcatcgcatttaagctccaaagcttttgcgatgcctacattatttcctgcattataacctttattttctttattctttatgtatagaatctgatactgctgtaccattgcatccagatcatattctggcatatttggagatgcattatctaccaaaataatctgaaaagattcttttggcggatttttccatatactccgcacgcagcgaagagtgtcatcccagttccgataattcaaaattacaattcctatcatctatttctatgctccaaattgttttttccgatgtttctgcataagctttgccggaatcattcccgctatcaagggttttatcacatacttccaatttccgtttaatattcccagtgctcgaaatccacgataccgcactcttgcctcattgacacgatattgatattttcgcttggaaaaagcatgtacatcctctctataccgaaacaagaattcctgcaaattatatccacgctctccggctgcgtacaagcgcataaacaattcgtaatcctccgtccgcaatgcacaggtttctgtagagtacccacctagtttctgcataacttcagctcgaacaagtatcgctggatgaatgaaaactgatgttctcagaaaatctttcttctgtggtacttctatcatcaatcgtttaccccacacaccctgatcgtctatgaattccgcattacaccccacaagcgaatactccggatgactttccaggaaaagaacttgtttttccaatcgattttctttcgaaatatcatccgcatccatccttgcataatattttcctctggcatgcttcatacagcgattcaatgtataagataatcccatatttttatcattacgtagtaaccgaatgcgagaatccttccgacacacatcctgcaaccatgcataaaattcatttgtcgatccatcatcacagataataaactcaagatctgtaaaagactgctgcaggatggaatcaattgcctgaatcacataatttttattcttttcgttataaattcccatgagaacactaattataggattctttttttcatcgtccatcttgttactccgctatatacacattttccatcaatctttctaccgccgatcttccaaacgacttcacattttctgcattgatctgtcccatcctctggaaatcagtcagttccttatgtttcatttcatacagcttccgaaatgctgcttcgtaatcttctttgtttccaggcgatactaatataccaccctttccatcttttatcaaatccacatttccgcgaatcctgctgcacaccacaggaagtccctctgccatggcttccatcagtgccaccgataatccctcccggaacgaagacaacacaaaacagtcggatatctgaagaatttcatgcagatcattgcgaaatcccacaaatcggatatgttcctccaatccatgctctttcacatactgttccaattctgctttcttttctccaataccgcacattacaaagtaaatatttggattatgcaattgttcgattgcctcaatcaccgtcttctgatttttattcggagtgaactcagcagcatttgtgatcaaaaatgctgcttgtggaattcccaactccttacgtttctcttccttttccttttgagacaaaccttccctttgtgtatctattccaatccctggcacgtaggtaagctttttcatcttaaatttcttttttgccagcttgtagtcctcatgattgatcgttatcaacacatccgtccatctgctcagcatcttctccaccggatagtacaccagccagttcataaccggtgccccctgatagaaatgaaacccatgtgccgtatagatcacttttgtcctggtccgatgtccggcaatccttgcgaccacaccaccgatcgggctgtgacagtgacaaaactcataagtattctgcttcatcagtgcttccacctgccacaacgctttcatgttttgtcccatatgcttgatattccgtgcgaaatcgatctgataacagtgcacgtgcatgtcctgcagtttttgtttcagttccgcgacgcgcgcatccgagcaggtatttccttcaataaaattgcaggccacatctacctcataccccagtttctgcagcaatgcaatgtttggcatattaaattgatcgatcattgaggcgacggacgccagcatcaggactcgtttcatcttttcctttcacaaaatactcaactaattaattcttcttttatagtatgataatattgatgtatcttcttccatcccaatacatcaattccaccaaccaccaaagtcaatattccaccaataatagttataaatataccaccccaatcatttgtttcaatcacacttcccttcattgcaaacataaacatctcatacagaaaggcatgttgatccttaaagacaaaaatatcaagcatttcatacaagacaaaccaagaggcaagcaccataaatgtaacccatacaattatctttaccatcgcccaaaacagattcttcccctttttatcattttccaagctaaccacacgcttctcaaggtcattgtccgttttctcatctttatcctctaccatctctaccttgtcatccccggtcaccggagcaacattttcttccgattgctcgacaaccaccggacgaaatggaataatttctttttccggctcgcatgtcatatgaaagatatccggatacgtctcttttgtatactgcataaagtcattcttggaaacactgtaaaatggtctcccctcgttttctacccgtgtcggttccaggattgcctgacaatgatagcattgatacgaagcagcaaatccatcacatacgaagatattctgactatggcattttgggcagctatagtgcagttcttttcgaaccagattttttgcacacagaacctgcagcatacttttggtatatgtaatttccagatccagccgttcactcaggtcctgcgtcgtaaactgcttacattgcctttgtgtcaactgcggcaggattttcatacattgccgaaccgcttctctttcgttcatactctttataaagcccccatatctgctggaattcttcttccgaataatattttccttccaaaatgtgcagcgtcagaaactgataattatcagcttcatatttcacttgtaatacccctcgcgctctcggaaaattgaccgtcagggaaataattcttttcacgatatccaaagaatccctgatacacataaacgtcttggcatcataaatacaatctacaccattttctcctgttaagtttgccgacagattatctctgtcactgaatcgaatttttgatatatatttttcatcgcttggaagaagcgtattcaatgcatgatcttcccggtaatcatataatgcagtctgttgaatcaggcgatatagttcttcctctaaattaatgattccatccggcatatataattttccgtctttttgttctacatgatgcaacggaatattttgtaacattgcatcgataatgctgctcaggttctctcgcttatcatcaatctcttttatatttggaagccgttcaaaaaactggttgaacaattctttgctcatgtcatacaatacattctgcggatcagccgctctattgttgtccaattccagttctaaggtttcttctactatactatagattttatcaagctgaatctgcggacggctctcctgtataattccatgctgattccatactttaacaatcatgcagcgctgttccagatcaatggttaccggaagataggaacactcctcctcgatcggaccggcagaatcttttaacatgcagaacacaaaaatcagatgcaccctgattaaatttccattccttctttcttcctgtatcgctgcaagcttcgtggagtcttccttctgtgggaccgtctctatgatctggttgtacgtccaatctgggatctgaaatttgcgcataagtctgccccacgaatccctgctctttaagcgcagacaggtcgaagcagttaatgaatacacgcgcatcaatcgatgatgaccatataataattcttgaaagaaaaaatcattcagatcctcaacagaaatcaatccgctttgacaaagctgttctagcaaaacccgctggtccgaaaaagacagcctctgctcatttgcaattttctgttcggtaagaaatctattcaggcttgttgatgatatattatcgataagttccttaactatatgcattctcttgtcctctgtcttccgtaaccccaaatccaataaatattatttttattatatcacgaacctttatcttactcaatgtaaaaaaccggtcagacttatcatccaaccggttttgccggaaaaatcattttttattccttcatccacaaattctttttccaacgcaatttggcattatacatactattcactccgaaactccaaaaaatactgcgtatataagttttcacataatttcaaaatatccgtttgtgaaaaatcctttaatttttccataaacaaatctacaatataattagaatacttctttttttctctatattttccgtctgcatttatcacatcttcaaggaattccaccaacgcgttcgttttaaaaccaatatcattcaatcgaaactgattaatatgatgctctatgtaatcaatatcattctcatcgtattggtatctcgtacttggaataaactctgcatttttcacatcatactgcagacaatatttcaattgtgaatttattccatgtacgccatgtggttgtaaaataatccgtgacactttaccatattcctgttttaattctttatatgggccacattcctgcttgcacattttcccactacaattcactttttctcgaaataattctatctgtggaaggatttttttacaacgttcttcttctccagtcctttttagcgactgattacagtgactacaagtaagcgcaatattttgaacacattcttctaaatgttcttcatctaatttcttttcaatactatgttcaagatttcctgtgtctactctatcacttttaagtagggcataacaatacatacaatgatttttgcttatatttcttagcaattctaataaatttttcccggccttgtttttatatccatactcaattttttcctcataagatggcgaaaaatcaggaatatccaataagaaaaaatcgtttttcacacattccactcctcaatttgttttatgatcattttctgtacctttgtaatttttcctgcctttatagtacaaagctcattttcacattcttcattccaaatgcccgacattttattgttaaataacacgcgcaattttgtatcaattacctcctttgatgttttttccttttcaattttgaaaacatccttaaacaagtcatatacttgtgatatactcctaaaatctcctgcatctaacacttcataattcgtatttctcagtaaaacaatattagcattttctgtttcagcaatcagatctgcggaatgcgttgttacaataaagtttaatgttggaaaatttattcttagaaaatcaaatatttttccacaattttttacagataaaaattcatctatctcatctataacaattacgccttcatgcatcgtgtcctcataatataatatttccaaaaaaattctaattaacgcttgataaccacttgataaactaaatctttcatcattaacgtaaactactgctcctgtcagttcctgtttcacttcaaattctatctgcaaaaaaatctgtataagtttctctaaccgttctttataattaaaataaaaatcttcaatagcctttggtgttcctccataatagaacgaatccttatgattaaaaatatcttcatttaaccgagtatcatttattttggaagagtatactatatttttttccttttcaaaggtaatttgtttcacatcaaattcgcgattcactgcatcaataaaataatacttccgcctgtcaccgttctctatgacgccttttaaaacatccgatttaccactggaattatcccccaataaaatggtatctttatatggcaattgttcaccaatcattttttcacacaagtcactgaccatagcctgataacaagtcatatatcattttccaccttttattcatatttgtgcgtgaaaaggtccgcgcattcattgtactttttattcctgcatcttcagaaatgtcattatatatttcatccgtaattaatacattaatatgtgttttttctaaaaccacaaaaatcccttccgtaatcaaaaccttattaaagttttcacggctaatatctaatctacaaaagaatttttctaaactttcctgatattcttcgacttcttctgacgtaaaataaaatgcctgctccgtaaaagcatcaataaactctttgattttgattgtaccagaatctccttttatttgaaaatccattccatcatatttcacaaactttttcatagcacaaaaacgatatagtttttccatatcatcatatttatcactcatatgaccatacaattttctccatttgagatcatttcgatttatagcatctatcattttgctaaatttgcaaggatatacgccatttctcatttcctgatctgacaagcgtgttccaccattattaaggtttgtgaatattttgtgcagtgtagcttctggattatctatcattgatgtttttatttctacaaccgaaatagtagtgtaatcaacttttcttttgatgtcttttggaagtgtcgcataggtaatatcacatttttcctttccaaaaatcatataaaacttcgttggaacaatatcgtatttctttgcaagagcttcttcaaaattacttgtgtgatcaatatccagttctctgtaatcaaatacgttttgttgcgtatccgcaaaaaatcttccaatataataaaaatacagactcatcactctctgctgtccatccaaaatttcaagctgtccattttcatttcggaatgcatagattggtggaattggtaaatcacgaaggagggaagtcgccaattcttccacctgttgctttgtccatcgatattttctctgatactcaggtattacaaacaaattatcatgtaccccttctgctaacgccttaaatcccatatctgttttatattgttgaatactgatttttctatatatctcatttaaggaagtttctattagttcattttcctgtgtcatatattctccactctttattcttaatatttacagtttcagtttatttaccatagtaacacactttaatcatatctaccacacccattcctgccgaatctcattcatttcacactcatctgccgcaatctctttccagcgctgcacgccttttcccccgcttgtctccggcatctgatacatccggaacgcaagagacatgcatgcttttcgggcatgcagaatatctttggccggcatatcacaatcctgctcgactcgcagaatatctgcaagcatttccagacatgcatccatgtggttctggttgtcgcgttgccgtatgatctgacaatctgcataaaccagattatgaagaaagtatatcgcagacaccagccccggtgtctttcggtaccgcaggatattcaggaattcattcaataggacctgtgcctcctctgccgtgggatgtgccataatatactgataagctgcagtctgtgcccctatcgtaagttctttttcagaagattgcatttcttcgcaaacggatgctgccagagcatcactattagctatctgaatttccagttctttgatgctgatattatacgcacacatttcctgcagcattgattgtaattgttcggatacaagcgtacttatcatacctgtattgcgacacaacgcagcggccgttttctctattttctgtgcccggttccgaaattcgtctgctgcaaagctctccgggcgcaccttttctagttttcctcttaaaatacaccaatatgcctgcatatcctgtagaagctgttccgtttccttttggctccaatatcccggttccatattttcacagaccagaaccagctcatccagataagggatttttcccattgtacttctgcatccctgctgatcttcaaactgatcctgcaaacgcctcgatagaaaccattgtttaatagattttactagaatatttgcatccagacacggtaatttttcataagcaaacaggtgcagatcctttccctccggaagccctgttgtctctgatacataatgccaaagcaatgcagcatatgcctgctgctgtttttcatccaatagctgcagacggtacaaagtttccagacgaagcactttggttctccattcatatcctgcctcagacgggatttccagtaaccatgctatagtttctggtcttacaatacactttctctgcaacggaccgatatcttctttccggaaataataactgaaaatgtcaattccatccccatgtccatgcatggtcttgtgctctacaatttttgtctgcagcattacgtccagcatttgtgacttcttcgcttcagatacattttccataattccaacacccaactctgccatcgaaaatgataccggaagttcttctgattccatcaattgttttgcaagcaataaagcatcttcctgctgtgcatctgggcatcggctcataaaccggatcagcagttcgggaacatttgagaatatctgtgtaagaattccccctgcctgtggacgttcctgatccgccatttcttccatattgtccgaaagagcatgaatcagaaatgcaaccatatttcccgctacatccggtgaaagtgtacacagccatgcgcgatccaccaatgtttcgatcgttctgctgtagcacccacgacacagcaaaaataatccaaggtaatccatctgttccaacactgcttcgatccatggctgttccaaatctcccagcagtgtgacatacccacattttaatggtaatgccagcttatccaacaagcggtaaaaatggtatgccggttcacatgcattgcccgttccctgtatgattgtacgatattcctgatttaacggaaacgcttctctctgctcgtacttgcgcacatgccagcgaagcaatttatgttgcacgttgtctttccacatttcccagtcaaataatgcacaattactatctatatcttcctgtatccgatgaatttcttgtaaatgaatttcaaatttctgcgtataatcccattttccctgtacacaaagcatatataattgcagaatactcactctgagcgttttgaaatacagtccattgctcccgttcgatatctctgcgtcctgtatatcctgcataagctgctgcaatgcaggaatcacactttctagttcatccagttccgcctgtagccccaatatctgcaaacgctgttcataatgttctttgtccgggtgacaatgggcaatcgatcttcgcattgccggaatttgtaatctatgatactcctgttttgctttctctaactgcagatctatgattccgtttaccccataagactcatacgctttcagtctcgtatagatatttttccacgcttctgttcttccctcctcgcgatatacacgaagcagtacctgaccaatataaaaccatttctttatattttctgtttcatatatcgcagattcgtgactccagcttttgatttccttttcataataattgtcccagattatggacaagtgatggatctcataatcggaatacaaatgcatacatttttcgtagcgccatgcaagttcatatgcaaacagaaacatccgatttaaatcaacaaatgtatggctttgcaacagtccttcttctcttgttttgctgcttagttctgcgcatatgttgtagggaagaatgtaccaccccggataaacattacgttctttcttccatgcttcagtaagctgactgatatctttgtaccggttttcttttggtccaaacagtccttccacctgttgatcggataaatcccatttggctatttgccctatatccgttggaccattctgctgcatgtttttctctgtctccggtctcttttctgtctccatcctctgctgcagacgttcttcctggttctgtcggctccccatatcaatgatattttgtgtcgcacgctctaaccgatccattcggctgttcatttgttccattccctgaccaatttcttcaagccgtgatcttccataaatttccggcagaattttacggcatttgtctgttataatctccacaaaacgttgtttactcgtttttttattatcctcagacatagcactcccattgactaagttgtcgacacagatcacgagtctctccaaccacgtgtaatcatctaccgggcgcatgtgttctgccagtaatttcatattttcttcacaaaatataacattgcgaagttccgtttcttcggttccataccgccgaaactccctgatttgttttccggcatccacaaagatttgggtaaactggtgttcattcaaaaattttaatcccattgtaaccgggattgccttccagtctcctgtgcatatttgttttatgatttctgtttttgtatcgtccatgggtattctcccttatttatggtcttttatcttttggaaatcatttttcaatcgtactctttccgttacagttcacaagtcaccctgcaaactgtaaccgctcattttggcagtttaccctttcggcttcaatctgctcatcgctgattgaaactcccctctcggatcagcaattaatatctccaattcatgagacgttctccagccattcacagcttctacaacgtcaagcatgatctccaatgcctcacgcagctcatccactgtcacaataacaaaattatcccccggatatcttgcatcataataatagtctttgagtaatgccagatccttcctctctaattgcaaggaagtatccacccttttaatctcatcgtataaggcacgcaaattatgggatgtcattagtttttcaattccagtacaaaccagttctgccacagatttcaacattttttctgcaatttgctgtgccgaagctgcagccggattacagtatacaggtgacactgcatcccttaaataccagaattcattgcacgcaatagaataataagaatttgcctttatcatattttcaactccttataatctcttcttaactgttgtgtaaactttgaattatcatgttcgaaatactgcggtgttacaaaaaccacatccgcatgcaacatctcgagttcttcccgcaaggctcccatcatccatctttccggtttttccggaactatgatgcaaaagtcgatatcactgctggccttataatcatttctcgcgtagcttccaaaaatcccaaaactctgatatttgatactcgaatttttaataatatctacacacttgttcaaccggtctttaaaatcattttcaacaacaggtgacacgtacggcatccctaaacctccactctttctattaatctgtcctatcacagtttctacaatgtcaatcgtaatctctaatgtttcaacaataaggaaagtactttcggtctggctccccttgcataatggaagcccagtgcatgtcttacaatttccggaagatacagtttttcaccatccctgatcagatatccttcctgcatcatcaacttttcttctgtacgggagagcacattttcattcaaatccagtggaagaattttctgttctgctggcaatttttcaagtttttcaaaaatcggctttaaaaatgcatactccatttttatctcaccaattttttctttagaacaaattgataccgcatgccgaatctctgccggcataagaatacgatcctcataagaagctttttttccatttgaaacagctgcatatttcaggaaacgtatgatatccctcgcctgcaattgtccattaaaatcagaaagtgccgccagaatccatctggaagaatacgcctcattggaactgttttttcccaatttttgtccccataatttttccaaatgtaaatcaatcacttcctttgaggcattctcaataggactctttgcctcataaaaatcgtttaccgcctgacttaccacccatacaaccaatttaagtgcttcatcagatgtccattttagttctgcatacccattcgcctgtttaaattgttcgtagttaactgtgattgcgttttgcgccatatcacttctcagaaaaattacaattcccaaattgtcgtactttgccgccatgatattgacaatatcctggcacagtgtctgaaccgctttctgctgatttaaatcgccagatacatttcttaaaatttcctccagtccatcaatcaggaaaacggcttttttatcttctttccgcaacatatcactgacctcatcaaaagacccccaatttttattgacagaagatgccagaagtttttcccagaaatcacgccaatccgttatttctgtcatttgtttttcaagtttctgcgaattatccagatatacggaagctgatacctgtgcactttctatttctgtattgactgttgcaatacattctctcaacaattttgtaaattccgtaatatttttaggggcaaataccggaatgaaatacccgttttctttattattcctgtgattgatttcattactgaaagcaaaccagttttgcttttcaataaattgtctataaagaaaagtctttcctgcaccttttgcacctctgacaactaccgttggaataccatctgcgtattttaaacataaatttttaattggagctgtcagtaaaatttgaactgcatgattggattctgctgtgatttgcttattagcaaatgtgcatatctcctgcaaagctttgttccggtattcatcaaaattaatattgtcattttctatcggatcatcaagatacgattgaaccacttttttaatttctttatacatatccctgccttcaatctgtgttaatatctgctgaagatctgttaaatgtatcaattcgcttgcaaatggcagttccacgaccaaattatcaagtaattgttcttctttttcattacttttaaagcattccacaatttctgtaataatatcatttttttctttcagactgatagaaggcggaatcattcccaaaaatacggttggtaaatttgcatcctctgtaatagctaatcctcttcccatatactgtaaaagtttctcggttccaataacagactgctctgatgtagacgtaacaatatatttttttactcttggatcaaacaataacggtgccgaatattcgctaattccggctctcatatcaaccagcgtcatattaactccaagccgatccgcaatctgagaaagtacttctgccaatatgtactgacgatcctttcccttaataacagaactcgggcttgcataaatgtcaaacaattgttcatcatatcgtaacgttggcaaaaagaaatgttcaacggtttgctgatttgtttctactgatataacagaatttcttatctgttccgttgcaaattcaacaactgactcaatatcctgtgaatcctgtaacattgtaagcagatctaaataactaaatccattttcatcaatttttccctgtagccaggataaacctggtgcttcaatatccgaatcaataatcaggagttttttttctccctgcatttctgaccaggcttttgcaaatgcaagtaaggataatgttcttcctactcctcccttataggaatgaaaagcaacaactgggcatggtaaaggtttgagttgttcttccggataagccgaacgactgtaaatcactttctcaaacaacggaattattttattattccgtccctcatcctcgaattctatagtgattttcatcacctgcttattcccctcaagtaaaatacttttgttatttcgatccgtatttttaggaaatacctcatataacttttgaataatttcagaatcatctttttcttttgaacaataaacaatcaactcatcagggtatacttctatattgtcaaaagtatcctcccatccttttctttgtacaagcaattctctttctatatctttccacgtataatatctcatatctatatttcctcttttaaccaattcataatattctcaagtgtcttgatattttctttctctttgtctctgtccttttcttctaagtttatcccatatctgcacatctgatgatactgggcaattgatacaacatccccatattctgtactaatattaaaaaaagaatatctgcctgcctgtttgacctcatttaataaaacacggatatcatgtgtccccagtacattttttatttcttcatttgcagtctctactttatataatttattatttttcatcacaagacatttcaatccacattcaacacagtagcacaaaatcaaagacctgctacttttactgacatttatatacttttcatatgtatccgcatgcctttgaaatgcctttttataattcttttgattcgcccgtaactttttcgccacttttgtaaaattcctctcattttatatattttctttcatttactcctgttatacaatattcatgccttttccgtccttcttaccgactctttccagtcacacacacgatattcttccttatattcactcatctgcatatcgtacacactgtcaccaaacgctttgcccgtcagggtgccaatttttcccggaatctttttcatcagccggatgatccagccagtcgctggaaccatcacaagccggtgtccttttaccacagcgatcatctgcaccagatccgaagtattgatatactgctcgttctgcggaaaaaacactccggtctcttcgttgtcgatcatccgtttgacaaactgtgccagattttctatataaagcatggaacgctgattatgtacaattggaaatagcggaagttttcctgccagttttgcaagctgtggatagtttccctttgatccctttccgtaaatcatcggcgggcgcaatacaacaaccttaaaacgttcatctgccagtgcctgtattttctgatccgcctgccatttgctgtctccatagaaattcaatggtttgggaattgtattttttgtaattttcttttctctacatccgctgtatacaatcatggaagacataaagagaaactgctgcacgccttcctttttggctttttcggctgtctctactgccagatctgtattcacgcggtaatactgcttcttttcttcttccgtcacctgtcccacatctgcatgtgcgattcccgccacatgataaaccacatcatatgcagaaaaatcgtgtgtccgccagatttgtgttctcatatccagcgtttcaatctggtagtactccggccattgtctcagccatgcctccacggaagttcccacataactaccgcttccggtgatcagaatcttcttttttctcctgcccttttcacgttcttctgtgtcttttgcaatgtttttctttttcgtgctgctctgtgttgtttgttccggttccaatgccagttgcactttgcgttttttatttacatatatggttactgcaagttctgtcactgttgccaggccaaacaacactcccggaatgtttccttttttcttttcccggttctctcccttatgtaaaatatggtgaattacagcccaaaatactgccaacgcggttgctgccactgctccgcctaatataatttctctcttcagtttctgtggatcgaccagtccgcttttgtgtgcttctgtctcttcttccactttgttcagttcgccagttccaccttcaaccacgccatcgtgcatgagcacggagccaattgtgccaagaaaacatttcagatccatccatggtcccagatgtttgacatattcgccatccagtcttgccttgtccggaatctccagttcatctctgccattgatctgtgcccacccggtcagccccggtgtcacatcattggcaccatatttctcacgctctgctaccagatcatcctgattccacagtgccggccgcggtcctacgatactcatttctcctttgaagatattaaaaatctgtggcagttcatccagactggttttgcgcagaaattttcctacctttgtgatgtactgctccggattttccaacatatgtgttggcacatcctttggtgtatcaatccgcatggtacggaatttgtaaatttggaagaaactccggtggatgccgatacgcttctgcttaaataatatcggtccaggtgtatccagtttgatcgcaatacataaaaaaagaaggagtggtgataagatcactatcgccatcccacttaatatgatatcaattcctcttttgatgtaatggtatcctttcatggctgacttgctccttcctgatttcacactaacctgcacattttcgtaatctcttgatttagtcttctgagtatctcactttcctctattgttctctctgatacccagtcattgtctgcaattgaaacctgattcgcttttcctggtttcattacattcgtaatgcatcccacaattgccttattcttatcttgttctctcattaaagttgtctgaattgttgcagccttcccgacatactcttctgcaaaatccaatagctgtggatacacaatttttgctgtatctatcaataaattttccaaatttccacttccatcattatctgggaaaatatatgtatagacttctacttctttccttccataaaataacatagtcattttatcttcatgaaatatataatcagtctctttccccatattatccaacatcatttttctcttatcatttgcatttttctcatcagcatcacacactaacataatgccatccaatgataacacttctcttatatccatgagtttcaatgtctgcaccaatacattcatgatctcactatcactgccggcattcttgattgccacagatatctcttcattttttacgaaacttggaattggagagattctctccagccgatccccatgaaatggatacctgtctggaattgtgcgtctccagacaggtggaagttcacgttcagaatgtactattttatcaactccgtttatacgcaacagtttttggattaccgcaatatcatgcgccccctctacaataatcaagtaatttctcataaaatatccatcccctgtttatttaccaattccagtaattcatcacttcgaaactgctttacaaaagtatctcccatataatgttccaaacgatatgcgctcatatctatctgttgtttcttttgagcctgtaccaatgcattgacagcctcgctgctatgtgtagtaagaaagatctgtatatctctttcttctgctgctgatgcaatccagtcagcaacctgtaccaacgctctctgatgaattccggtttcgaattcgtcaatcaaaattatcccatgttttgttttcacaattgcgctcgcaagtgtaagaatttttttcaaaccatcaccaaacaaagatacgggcatcaatcctatattttccaactcaatcaaaatcgttggctttgcatttaacattccaatttctatacctataatacgttcatcgaataaccgcagcaactgaattaatgtttctttttctgatactctcattcctttgtaaaaattcgcattaagcacacgattggtgtatacatccattggtgaaatgtacactatactcactcttgacatattctctttttttatgtccagagtttctttcatagacatatccggtctcaattgtgtctctcgaaaagagtagctattttcagatgtcagattttcgcttatatataagaagtttccgcttataacactgatttccccatcctctccgcaataaagatcatatcttctctgttcactctccgaaagatcttctttatcataaatttctttttttattgttccacataattcaatatgccatttcttcaactcataatctgtcgcataaattactatatccttttgttctccctgtaccggaaaagaataaagaaattcatcaaacggaatcaaatttgcactttgcaccattatattcctaggttgacgtttttttgcaattgacagaacattatccactacctccggatctcttaaaagctgtatcgcttctaatatagatgtttttccggtattgttttctcccacaagaatatttaccctgctgagattttgtaatgtaatattctttaatcccctatatgcttttatatcaattgtttgaaacatgccgcctccaagtttttccccgtattttcaactatttatatgtattatatcataccccattttgtgggatattgcaataattgtagccggaggcaacatttttgcttaattgaaaatatacaaaattaagatcaaccttaattagatataacatattaagattaaaatttggcatctcctcccaaaacaaatatccgacctatcactgtattgtccctacaaatattaaaatctgaaggataataaatagttatccatttattctaaataatgggtaagcttatattaagaaatactaaagtttggagagatatatacatatgatttcaacatgttttgtaataatgggctttaatataaaaacaaatgaagatggaaaagaatacaatttagatctctcgtattctgaaataattaaaccagtattagatttttataaattaaattatgtgcgagcagatgaaattatgatagcagaaatgattgatgattcaatgtacaaatttcttttgagcgcagatttagtgattgctgatataacaactttgaatgcaaatgctctctatgaattgggagttcgttatgctctaaaaccttattctacaattataattggctcaacagatacaaaaataccatttgatttaagtcatgtaaggatttttaggtataagcatgatggtgcacaaataaaacacgatgaatgtatcaaaataataggaagtttaaaaacagtaatcaaaaatattatggataatactacgcctttaattgatagtccagtatataaatttttatccaatttggagccgcctagatataaatatattagtgatacaaattattttgaaaataatattaaacgatttaaatcggaagaaagtttaggaagtttaattcattttgcttatcaaaaaagagatgcaggatgctttaaagaagcaatcactttatataaaaaagcattaaaaatatctaaggacgagtatattattaaggaaattgctgtatgtatgtatcaggaaggtacatatcagtcctattacgatgcgttaaattttttaaataaaaatataaaaatagaaagtaccataaatccagaagtgttaaaaacacttggaacaatttataaaaatctttggttaaaaaaaagaattactgaattcgcggatcaagcacttgcttgttatgaaaaatcatttatacttttaaaaacatacaacagtggattaaattatggatttatgctcttggtaatgagttatattaaccaagaaagcataaatcaaaaattctatatgtggtcacaatatatatatagtaaaacaaaagaaatatgtttagaaaagtacgatgtagatgattattggacaaatgcatctcttgctgaatgttgcctagtattagacgaaaaaaatgattataaaaaatatttggagctctcaaaactgtgctattttgaaacagaaaaagaaaagaaatggaaaaatgaaaaaactcgaaagcaattaaatgatatcaaaaaaatgattcaaaaaataaaatacaataattaatattctaaatatttaattgttttataagtagaggtatgatattactttttaaatattcaaaatcaagagtattatttttggcattaggaagtatataatatttaataggatcaattgaatttaaaagtgcagtgtcttttatttttgattcttttatcacgaaaaatgggagattatgagcaatcgctaaagcaatttcgatatctagccatacacttgttgtataataatattcaccattctgatccatatattgatctttttcatacgcaatacaaagaaaaaaatcgcattgctttaaggcattatttattttgaaaatgggagatttatctaaaacttcattttgtacttcaactatacatatattgagcttatttaatgttcttttgatatagtttaaaattgttatttgctgtttgtttataggttttgaataacttaaaaataatttatacattttcatcctccaaatgtatgcttcgaatattttttatatataccagtttttgatgatagttattttttaaatattgaaggattttaggttgcaaatatatttgtttatatattgtgataaaaacaaaataaaaattaattttttgagagactgcatttttctttttgggggttagacaataagtaatatgcctttttatcatacgaaaaattctcacaaaaatattacaatcaatataaataatacaatcacagtaatctaatctttctgtaaaggcataattaaaatagtttccatcaattatagagttttctttttcaacaaaatcattaatatcaaatgttttatcaactatccatggagattcccaataataggaatctaaatgaaatacttctaaattcaataatttacctaatttatttgaaaaagtggatttaccactacagcttaatcctagaactacaattgtcatactcaaattttcccgcaatttcataaatttattttgaagaaatataaacttcaccattgtttagaataaatggataactatttattatctttcaagtacttcttctattacatcaaggattatatcacatttttccaaaaattataacataattccttattttaatccatttttcttatttaaatggcaatttattgtttaatctcaccgttttcccatcaaaacatcagctttcgacatccacattctgtatttccccgaagtctatcccataccctttcccacccatactgatacaggaaacaccactgttctatccatgtaattgttacatattgtacaaatttttcaaattttgccttatccaacaaaatctcccccatttcatgtaccatatactcctaaacaaaacttcatatacaaaggagaccacccatgaataatttacagacacacatcaacaactatctggaacactgccgtcaccaaaaacgtctggattccaagactctgaaagcatatcgcatcgaccttcagcaattttatgccattttttcatgcatggatgtttctgatattacaccggatctgttggaaaattatattggcagtctgcaccagaagtacaaacccaaaaccgtaaaaagaaagattgcctcggtcaaagctctttttcactacctggaatataaagaaatcatcgcccggaatcctttcaacaaggtgcagatcaaattccgcgaacctgtgattttgccgaaaaccattccattgcacacgatcgaaattttcttatctacgatctatgagcagcgcaccatcgccaaaacggattatcagagaaaaaatgctttgcgggatgccactgtcatagaacttttatttgcaaccggaatacggatttccgaattatgcgctctgcgtatctgtgacattgatttgtacgatggatcagtcctgatctacggaaaaggttccaaagaacgaattgttcagatcggaaaccacgaggtcatacagattctgtcggaataccgcaatgaatttctcccccagatggaaacctgccagcatttctttgcgacgctaaacggaacggcattatccgctcagtcggtacggcggatgatcaacaaatatgcttctcttgctgcaattgaacagcatattacaccgcatatgttccggcatacatttgccaccagccttttagaagcggacgttgatatccgctatatacaggaaatgcttggccacagctctattcatatcacggaaatctatacgcatgttgccatgtcaaagcagcgtgccatcctcactaccagacatccccgcaatacgtttcatctgtaaaaagcaaaacagcaattcacgtgccatgcacggaattgctgtcattgatagccgttctatttttacttatttattctcccccgccaattccgggtgatacgttggcacaattttcttgacatactcccggatgtcttccggttctgtcacaacgtactcttttaattcttccaaccgctgcatgaacttttcttcatccagctcaatcggtttaccgatatgaatcagattgtttgcagtgtcctgcattccttcttcatccatcaacatttcttcataaagtttttctcccgggcgaagtcctgtgaaaatgatatggatatcttcatccggcttgtgaccggaaagaagaatcaggttttttgccagatccagaatcttgactggctctcccatatccagaacaaaaatttctccacctttggcataggtgcccgcctgcagtaccagagataccgcttccggaattgtcataaaataccgcacgatatccggatgggtaacagtgaccggacctccacgctcaatctgttttttgaacagcggaatcacacttccgttactgccaagcacatttccaaaacgcacggctacgaaatctgtcttcgatctgcggttataggtctgaatgatcatctcacagatgcgcttgctggcacccatgatattggttggattgaccgccttatccgtggaaatcatcacaaatttcttcacaccgtaccgatctgccgcctgcacaatcttccatgtgccaagcacgttattcttaattgcctcgttcggactctcttccatgagaggcacatgtttatgtgccgctgcatgatagataatctccggcttgtaatgttcaaaaatccagttcatacgattcgtattccgcacggatgcaatcagcacaacaagatccagctccggaaaccggactttcagttcgttttgcacatcataggtcgtattctcgtaaatatccacaataatcagctgttttggcctgtgtgcggcaatctgccggcacaattcgcttccgatagagccgccgccaccggtcaccatgattacctttccggatacataatccatgatagactgcagatcaacggtcaccggatctctgcctaacaggtcattgacatctacatcttttaatttgctgacgctgacatcgccgtttacaagctggtaaatgccgggcagacgtttcaatgtacatccggtttctttgcagatatcaagaatccccttgatctgtttctgcgtggccgatggcatggcaatgatgatctcatgcacatgcagttcttcgactttttccagaatatcgctccgatctcctacgactttcgctccatgaatataattgccgatcttgttccggtcatcatcaatcacaccaacaaccttctttttcacatagcggctgttgttgatttctttgatgatctggtttccggcatctcccgcaccgattacaagtacatttcgtctgtacacaccggctctgcgcatattgcgaagcacacgcagtccgcggtaagaatatctgcatcccatgaccaatacaaacagaaacaatccatacagaatgtaaaagcttcttggcaccgggtacatatccccccagttccgaagcaatatcagcactgtcacaacaacggtatccagaatacatgccgaaaccacatacatcatttccagtgctcccgcatagctccagagactggaatacagtcggagcatccagaaaatgatcagtgtaacaattatcataaaaggaagtgctctccacacttcatccatatattgaaacggtacgcttttgatattcagatcaaaccgaatcaataacgcaactatgcttgcagcaaacactgcaagcacgtcgtagcacatcagaaaaatccgtctgatcagtaattgtttatcttgaatgatttttttcataatttcaatctgttatttttgattctttctctgttttctcgattgttttttcgatgatttcttcctgactgaggattctgtcgctcctgccccttgagtattctgtaccgtctgcacggtatctgcttttgcactctctgctgcttttggaatactctgttttacggcagtatcactttctgcagaaaccgtttctttaacaacaaagagattttctttctttacaagcatccggttcaccgcaagtcccaggccaagcataccccagaataccggagcggtacatacattggaatcatttgcgatacctgcaatcatatacaccagcactgccgcaaataatccaaatccaacccagctgatactctcatgtagatcgactctgcggtaaatgcgtaccgactgtaccagataccagaacagaaataccagaagtgccagggtaccgagtaatccggtttccacccactgctgcaaataccagcaatgagcttttacgtcatagctgtttgcgccgtagacatagttctgactgatataatcttcctgtgacacttcaaacatataggtatttgccccactccccataaaagcatgctttccaagaagcggaatcgttttattccagatatgtcctcgattgctcattgcatcatccaaaaacagtgttgaaacttttggattttcaaactttaccagttttcctgcaggattgagatattcatatccgtccgtatcattttttgagaaatcccattcgacaccatctatgatcatctttattcctgctgtattatcggtaaacatgatcggctgaatctgtatatttgcaaaccgttcatcattgagggccaaaatatgattttcctgatctacctctgttgtctgaatctcctgaccatctgcatctttgcataccacggtgattacaccgtcgctccccagatcataggacacatacagaggattgttccagatatcaagttccacatcatctgtgtttgttttgatatcgtttaaagagaactgatctttcatatgataggttccaacaaccgtctttttaagagtttgaccgatgcctgtcgtatttgccagcactcctgctgcaatcactccaatgacaactacaacaatcccggctgcaaataattttttcttccgactgagtaaaaccaatgcgagaatcacagcaccaattgccagtgcaataaatccggaagaacttctgctaccaaccagtgctacaatgcaaaaaatctctgcaaccgcgattacaagacgatgccacatctttttcgccccaataaacaagcagaccagcaatggtatcagcatgccaaaataaaatgacaaaaagttaggattgtaaagtgtcgtatacgcagtcttatctgcgaaattaaaggaaatcttatctaactggttccaccagcttgtgtccgtcatcagatgtttgcccagagatgtcttaaaataatccaatccaaagacctgaaaaaatccaatcagagtaacaattgcgattccaatgccggaccagcgcaggattacctctatctgtttttcttcctgtacataattatagacataataacacagtatcatatagacaaatacaacccatacaggctcaaaaagttcatatgtaccatgtgccacccagtatttgtgactggaaaacagagcagacattgcaacaaacaatgcatacaccatcagaaaataaaaggaattttcaaatttaaatttcttcttattcaaatatcggatcagtaaaattgcgagcattacaactcccacaaggatgatcgcaatcatcttccatgcaaaaaagaagtccgtctgctttgctgcactctccggataccagtcaaactgtgccagatttgtatcataaacaaaagaatgcacaatgattggaatcaatccgatcaacaaaataatgggaatcaatatcttatttgcttttaacgtgtttttgtttccattcgtattcaagattattttctccttatgtttcattgcctataatcataccccaaattttattttttttcaatcattccggcatatggattttatttttcttgttattaataggtaaaaacacttttttgttacttgtgtgttacttaaaaattttacaaataaatgtgtatgattgacacgataatataaatttttacacacgaaaggaagaaaaatgagattaccaaacggatacggcggagtcgtaaaactctccggcaacagaagaagaccctatgcagcacgcatcactacgggctggcacatcaatgacatcacgggaaagcgcatccagcactatcagattttgggttacgctcctacccggtcggaagctctgcagattctggcacgttacaataattatcccatcgatggggaaacgctgaaattaaccttccgggaaatttatctccgatggtccgaagaaaagtttcctaccatctcccactccaacatcaaaggttatcgggcagcatttgccacttgtgaaaacattgctgatatgccatttcacaatttgagactcaatgatttacagcaggtgattgatcacagtggcaagaactatcctaccctgaaaaaaatccgtgttctttttaaccagctctattcttatgccatgaagcacgaaattgtctcaaaagattattctgcctatgtaaatatttcgaaatacaaagaccggaatccaaataaaaacatacgaagctgtttttccacttctgagattgctctcctgtggaaacacaaaaacgatccctattgccagacagtcctcatgctaatatacaatggagtccgtgtctcagagcttttggatctgaagaaagaaaatgttcatctgtccgaacaatattttgatgtcattgacagcaaaaccgaaaacggcattcgaaaagttccgattgctgacaaagtactccccttttaccagcgctggcttcatgactgttccgattgtgaatatctcatccatactctggacagccagcattttacctattatatgtattaccacaatgttttccagcctctgatgtttcgtctgcacatcgatcatacacctcactgctgccggcacaccacgatttccctgctcgccgaagcacatgtggatcagactacgatcaaaaaaattgtcggtcattccggtgcaatgtcattgaccgaacgggtttacacacatctggatatcccggcattgctggatgcaatcaatcggatttagaagattcttttgtgtttattacgtgttacttacggaagcaacggactgtcaaatactgctttccagcccagtatttccggcatttttcaaaacaataccagcggtatttacggttaaggtaactgcaaagaagaatggcaagaaagtttctaagactcttgcatctaacatcactgtaaagaattacaaggttcgtcttgaagatgcaactggtgcaactgtttccggaacaacaatcgctgttgtaggaacacctgtacagttcacagcaaagacagcaccggcaaaggctgcagtcacatatacttctagtgattcagcaattgcaactgtagatgctactggcaaggtaacacctgtaaagactggcaaggttacaatcacagctgcaacagataaggcttctactactgctgaagttgaagttaagaactacgcattaggcacagtttcccagacaaagcttacagagcttacagctactgttgctggcaacacaaagaaccttaagcctactgatttcgtagtaaagaacgagacaacaaacgttgtttatccagtatctaaggtatctgttgattccaaggatgcttctaaggttacattaacactgttcagcgaagcaaaagatgctgctacatatgatgtgactcttgatgaaatcacaaagacattcgtagcttctgatggaaaggttgcttctgttgcacttaataccgtaacagttccttatgcaactgaaacagaaatcggactggtttctaaagatgcgaatggtgttatcattgatgaggctgcttacacaaagcaagatgcttctaagtatgatttcactcttacaaccaataatggatatgtaaacggaactaagttatatttaaataagattgctgatacagctactgctgaaatcacatacaagtctggcaaatatgatcagaacggtaaggctgaaggaaatgttacttccggtaaggttacaattactgctgtcgatcagtctgctgttagcaactttgatgtaagaattgatgatggcaataagtcttatgacaaggctaaagatgacaagaagatcgcagctaaagatacaaaaacagcttatttcatgattaaaaatgctgacggaaaagaaatttccgattacaataagtattctgtagaatcttctgatcctgcaacattaatggttggtactcagaacgatatcagctcaaagaaagttagtgttacaggagtaaaagaaggtactgcatatcttcttattaaaaaagatagcaaagtagttggatctgttgctattacagttgttgctgaaaaggctgtagctacattagagttagacaaatataatgtcacactttctaatgtaattcgtagatctgcagatgtaaatgtaacattaaaagatcagtatggtaatgacgtaactagcgcatatgcaaatgatattaacgtagaaaacttaacaaaaccttctaaggcagctggaaacaagttttctaaaactggtgcaaaaatcactttcgctcctggagatgtagctggagattatacatttaagatttcctacaagaaagatggtaaagaagttgttgcgagaacaattgttgtctctgttaaggatacaacagctacaaaagcaaattcttggaagttaaacattaccaatgataatgttgatatcaaggctgataaagataactatacagacaaggttgttaaagctgaggttatcggttctgctgatggtgcagatctttatagtcttacaaatgtaaaatatgtggtaaagaaagctgatggaactgttcttttcagtactgttagcggcactactcctgcaaaagctccagaggctggagtattcactgttacaacaaatggtgcattaagcattaaagtttcaggtcagtctcagccttcatacccagctaatggagtaactaattatgtaattactaagtatcttgaggcaggaacatatactgtatatgctgaaggtgtagataatgtagattctagtgttacagcaaaaatcacaacaacatttactgtaaaagatacacaggctaaggctacagcagaagttaaggccaatagtgtggatgcaagagctactactggttctgcagtagatgctgttttaggagattctgtaattgttaagtatggcgattatacttatactgatagaactgattacacagatgcacatgctggattggaagtttgcagcattgaaggtacaaagaataatggttcttctattgtctacaataataacgctgccacagtaattggtaagggtgagggattcacagttacaaaggttactgtatgggtaaacgttggtacagatgatgtgccagtatggcttgctgtagaggttccggatattactggatacttctcagtaaataagtaatttgatacaaagctaatatttatatcccgtttaggtttttcctgaacgggatatttttatattactttaaaaatttattattggaaataggtcattaagagataggcaagtaacaaatcaagcgtgcaaaatgaaattatattttcctgggtaatccgctatactatgtttatgaataaaagcaatggctgagtgggaggcttttatggaacagtgattaaaattaccggtgggtattgatgattttgaaaaaatccgcagaaacgaaaaataccgtgccttgattgctttgaaaaatgggaaatatgccatggaggaagggcttctcatatccagcattcaattgctgatgcacggtatgatgaacaattcggatttacggatgtagaggtgtctgaccttttggaagattatgatttgtctggacactttgcggaaataaaggaatggtacaattattgttgttttagaaattcagttatctattattgataaaatatttagagttttttacaaacgactttacagcgctttttacaaaaagctatgccatatgccaaaatattttccctgccatcattccgcagagcttcgtcatatctgcgatctctgatctgctgcattgctttttcgcaggcaccgtccagttccaggaatgtcgcagcatatttcaattcgatgatcattcccgcatccggatcttccggctcaatcaggatatcacagaaaccgtctccagattccacattggagcggatcagccagtcacgttcacttcgcaacagaccaagcagcaagccatgataaaagttttccttctgttcgtcacgagctttggtatctaaaatactgatcatccggccaagaatctgtgtcaggtgtttttgtattttttctgcatccccatctaaaaatgcctggcacagttcctgcattggttttgcgtcttctacaatcgtctgacggaaccattcttgtatctggaacacaaacacttcacggacttctttgtttgggatgaccagccggtaaacaccatcaaccgctttcccaacttgtgtcaggtatcctgtggtaaacaggacactccagagattatctatgctgttgtctatctcatcataggtcagttccagacgaattcttttttcgatgggatttcctgcaatcaattgttcaatctcatcgcgtgtcgtcttgtctgccttgtcgacaaaacgtttgaccaatccattaccactggtattgatccaaaaggcctgtggatctgcctgaggatcgatgagtaacttttttacgtgattaatcacatcccacgggcagtaaatgtcagcatttccaaaacgataaccgtcataccattctttcatttcagaaaaatgctggtttaacttataatcatccaaaatttgatgaacttctgtgtctgtaaatccaaactgctcgtcatgttccacatctaccactgagttaacagcaaagttgttaagcccagtaaaaatactttcttttgaaatacgtaaacaaccagttaaaactgcaaactgaagggaggtattggtttttaatgcctggcctaaaagtccgcggatcagcgaaatcatttctctatagtaaccattctgaaatgccttatccagtggtacatcatactcatcaatcagtatcacggtcttgtgaccatagtgtttatgcaataacctggatagaaactgcaaactgaatgtaagtgtactgtctgcaaatacatatcgtccttctttgaaagtggtcagtgcaagatattgttgtttttcttcgtctgacagttcaggactttctttcaaaaaaggaaaacgtcctgcttcatttccgattaactgttgcagattttctttagcttcttcaaacgtcagcccttcaacacctttcagtgaaagaaaaataaccggatatttccccatataggtatcacacagttctttgttgcctgaaatataaagcccgtcaaacagggcaggggcggttccgatctcaaaaaagcatttcagcatgctcatgttcagtgttttcccgaaacggcgcgggcgtgtgaacaagctgacttctccccagttctgtaaaagctgttcaatcagctttgtcttatccacataataaaattcatttctgcggattttttcaaaatcatcaatacccaccggtaatttcaatcgctgctccataaaagcctccccttcagctatcacgtttaatcatacccatagtatagcggattcctttctaaaatacaatttgtttcgcatgtcttattttgttacttgcctgccacttatgtgtgtattatatgttacttgccgcaatattttttcgttaaatcttttccgcaagtccagtattttcagcctgttttttcaacaataccagcggtatttacggttaaggtaactgcaaagaagaatggcaagaaagtttctaagactcttgcatctaacatcactgtaaagaattacaaggttcgtcttgtagatgcaactggtgcaactgtttccggaacaacaatcgctgttgtaggaacacctgtacagttcacagcaaagacagcaccggcaaaggctgcagtcacatatacttctggtgattcagcaattgcaactgtagatactactggcaaggtaacacctgtaaagactggcaaggttacaatcacagctgcaacagataaggcttctactactgctgaagttgaagttaagaactacgttcttaagtctgtagcacagactaaggcaaatactttagagactgttgttcttggtaagacatctgacattaagccagcagacatcaagatcacaaacacagcaaacaacaatgcaattgctgttaagagcgtatctgttgacaaggctgacgctacaaaggttactgttgagacatttgctgatatgaaagatgcagctaagtacaatgtagaacttgacggaaccgttcagaccttcacagctactgatggtgttgtaacagatgtaaacgtaacacctgttacaatcgcagcaaacacaaaaggaactgagatcaagggtcagactgttgataaaaataatatcatcattgatgagtttaaggcttctgaagcttctggaaagaatgcagagttaaatctttctacaacacagggatatgtagatggtgacaagcttgttcttccgactgtaggaaacaagggaacagcagaagttaagtatcatacttataagttcgatacaaacggaaacgaagttggagcatatacaaagaaggttgatatcacagctgtagctgagaatgcaattacaacaaccggattcaatatgacatttgcaagcaaagttcctaactgggacaaagatacagcttctaaccagttagcaatcaattctggtaaggatgcatatttcaaatttgttggatctgacggaaaagaaatttcaaactaccctgattactctgtagtttccagtgatgattctattctgttacttcctaagacaacattgacaaacagcgcaacacctgtttctgtaaaaggaatcaaagaaggagctgcttatatcaatgtattagataaagatggaaaagttgttaaatctttagctgtaagtgtaactgcttctagtaagcttacaaatgtaacacttggaaatactgctattacaatttctaagacagcttctgttgataacaaagtaagtgttaaggccgttgatcagtataataatgacattactactgcctctaaaattattttaagtggtgcaacatctgatgctgataaggctatcagtgcaacccgtgatggcaatgatgtaaaggtagtcgcaacagctgatgctgaagcaggaaaaacatatactgttaaggttgaagtgaaaaatggtgatgtaactattaaccgttactttactgtaaaagtagttaaaaccaatgatgatgtgacaaaggcttctgatttaagacttgaagtatctggtgtaaaagatggcaaggtagacatggctgtagctgatgatgccgatgcagaaaaggctgctaagaatgttactgtaagagttgctgcatacgatgcaggtgcaaagattggttatgtagataatgccacatatgaaatcaataatgataagcagtctgttgttacaacatctacaacaggtgcatctatctcagttgtatcttgcggagcagctaccgtatctaagaaccttgatgcaggtaagacatatactgtaactgttaagactgcaaagaagacctttacaacaacattctctgttgtagatactcaggcttctgcaagcgttaaggttacaaagaaagcaactacaaagacaaatgcagcagatatcttagctgagacttgtgaagtaacttacgatggaaagaagcttgagaatccagaatttacatttgatgatgagtctaaagatgttaagacggtaactactcctacttctacttctacttatatcgctaaggcaaacgtaaaagtaacaaataaaaatcacattacttacacagtaccagttactattaacacagcatttacatttacaaaataatttattattgtaaatagtttttataagactgtcgcactatattatggtgcggcagttttataagttaaataattgatgcagtaattctaaattataaaaatagtacatggaaaattataatatgagaaaattgctatatttagttatccatgatgaaacatcgtatcttcgtatcataataaaagtcaggctaaagatgacatgataaccagaaatgccgatgtattaactgatgctttagaacaaaatgaaatagatgatctggaaattgaagatattgaggatgtcggctacgatgcagatggatttaaaatcggaaccattgatattacaaatatcaactttgccgaagatcccgggaaagaaataatgctcgagactttggaaggtggagatgaattttcaattgatgaattaagaacttttatcaaataacaaaagaaagcggataatgagctatgtacgataaaatttcggaagtaaaaaataatatgaaaagaataatcagagccagaggtatgactcgctctgaaaaatatacccaaatcaaacaactgaatcaatcactgtcatcaaccgaacaaaacattttaataaaagaactccatagagactgtgactattataacactctttccgatataaaagaaataattaccataagcttaatggggtttccactcttgctttctatttatagtttgtggattgatagaaatggaattaaattttctgattatacgtcaactcttaagtatattttggtttttaatattttgtgtctctatatctttgttataacatcaaccttaaaaaatcactgggtaaataatgcaaaatatctgctggatattttggaagatgaataaaatggactacccgctgtttaaacgatgctcatctacagattctctcttcatttcatatgccactaactgtttcaaaattttccgttatacctctactgggatttgatattctgctgatactaaattttagtttgcactatttctcttttacataaaatatttttagttgtcgcaaatcataaattaaatcatcatatattccgtacattatcccttcaatgaatggaatcaaggtataaactgcaacaaatataaatatacaatacaccaataataatataacattactagctcctacattagatgaagtaaattgttgttgaataatgtatattgtgattggtacaattaatacactgagaactttaacaggttttttgattggcaaaaacagattagcatcctgtttggcttgcttagcttcatcaatcaataagtcaattttttgagtggtgattggcaaattattttttgataaaacggtaactttcgaaaagtaatggttgattttaactgtttatgtttcttcttgtaactaagcataaacgtactgaatctcatgttgtgtccacctcataaaaaaaaggttgcttcgacagcctctttttataaaatgtaattattttaatgtaattgcccgagaattagagtttccgggtttatggggtcagccccataaattctaaacttacatggtcttattttaaaattaggtgatatccctcctgaaataagactacaacttcatgcggtcgcgctgctgagaatctgcagttaattccgatttggcacaatcgggtaggcggatacatcaaaaataaaatgcggttagcacctaccacaatgtgccgttggaccaaaatttaccttatacattcaattttacgcctctacagggatttgatatccggccgcagacatttctttttcaaattcttctacggaaagattcagtttctgagctccccgcacaactccataatcaccttcctgtacggacataaatacttcttttttacgaccttctgcaagtccttcctcccggccttcctcgcggagaacatcttcatatttcttttcatcaaattcagtaagacacatatcacacacctccctgcgatgctgttccaaaaaatctctgagaatattttcctctatgcattccctgacggcaagatcaatggcttcttttaattccatggaatcccggtatcttttgatctttgcaacaaagaccgcgtattcatataaaacgtggcagctgtccatgatggactgattttttccgctgtttatgttaatcattgtggctgtccattcatattcaccagctccggtatctgtttcaaaagcatccgataatcgtagaatccttctttcttctgcaaggtccttttcgcttccgttgtaaaatacaatataatgaggacgcggaattttcagcagatgtttgctgtacagtcgctcagagcggtggctttgtttatttacctacattatagcatatggcacagggatcacaactgaaacaatttgtcacattaaaatctgatacataaataaaattgtattttaaaggagaatccgctatactgtaactattagaagaagcaacggataggttggaggcttttatggagcagcgattaaaattacctgtaggaatcgaattttttgatgaaattcggacatccggttattattatattgataaaacaaaattgatcgaacaattattacagaacatgggaaaagtgagtttgttcacacgcccacgccgtttcgggaaaacactgaacatgagcatgctgaaatgcttttttgagatcggaaccgcccctgctctgttcgacggactttatatttcaggcaacaaagaactgtgtgatacctatatggggaaatatccggttatttttctttcattgaaaggtgtggaatgattgacatttggggaagcccagggaatgctgaaaataattctcagaacagaagccaatcgacattattacttaaaaaccagtacgaatatttcaaaagaaaaccggaaattatttgaaaatatgttacttgggcattttgaagaattatcagacagtgtgcgtctgttatcccagatgctatcagaacactacggtcagaagacggttattctgattgatgggtatgatgtgccactcgacaaagcattccagaatggctattaccgggaaatggtatctctgatccgcggacttttaggtcaggctttgagaaccaatacttcccttcagtttgcggttctgaccggctgtttacgtatttcaaaggaaagtatttttactggtttgaacaatttcaaaatcctgtcaattgatgatgcacgatatgatgaacaattcggctttacggatgcagaggtgtctgaccttttggaagattatgatttgtctggacactttgcggaaataaaggaatggtacgatggttatcattttggaaatgctgatatctattgcccttgggacgtgataaatcatgtggatcatttattgcaggagccagatgtctgtccacaggcatactggatcaacagcatcggaaatgatttagttaagcggtttgtagacaaagcagacaaaaccacacgcgacgagattgagcagctgattgcgggtaatgcaatagaaaaacgcatccgtctggaacttacctatgatgagattgaaaacagtatcgataatctctggagtgtcctgtttaccacaggatacctgacacaggttggaaaagcggttgatggtgtttaccggctggtcatcccaaacaaagaagtgcgggaagtgtttgtattccagatacaggaatggttccgtcagacgattgtagaagacgcaaaaccaatgcaggaactgtgccgggcatttttagatggggatgcagaaaaaatacaaaaacacctgacgcagattcttggccggatgatcagtattttagataccaaagctcgtgatgaacagaaggaaaacttttatcacggcctgttgcttggtctgctgcggagtgaacgtgactggctgatccgctccaacgtggaatctggagacggtttctgtgatatcctgattgagccggaagatccggatgcgggaatggtcatcgaattgaaatatgctgcgacattccgggaactggacagtgcctgcgaaaaagcaatgcagcagatcagagaccgcagatatgacgaagccccgcggaatgatggcagggaaaatattttggcatatggcatagctttttgtaaaaagcgctgtaaagtcgtttgtgaaaaactttaaagaatgtgccaaaataggacatgtaaataaaattgtattttaaaggaattagaaggagcagcgaataggttggaggcttttatggagcagcgattgaaattaccggtggggattgatgattttgaaaaaatccgcagaaatgaattttattatgtggataagacaaagctgatcgaacagcttttacagaactggggagaagtcagcttgttcacacgcccgcgccgtttcgggaaaacactgaacatgagcatgctgaaatgcttttttgagatcggaaccgaccatgccctgtttgacgggctttatatttcaggcaacaaagaactgtgtgatacctatatggggaaatatccggttatttttctttcactgaaaggtgttgaagggctgacgtttgaagaagctaaagaaaatctgcaacagttaatcggaaatgaagcaggacgttttccttttttgaaagaaagtcctgaactgtcagacgaagaaaaacaacaatatcttgcactgaccactttcaaagaaggacaatatgtatttgcagacagtacacttacattcagtttgcagtttctatccaggttattgcataaacactatggtcacaagaccgtgatactgattgatgagtatgatgtaccactggataaggcatttcagaatggttactatagagaaatgatttcgctgatccgcggacttttaggccaggcattaaaaaccaatacctcccttcagtttgcagttttaactggttgtttacgtatttcaaaagaaagtatttttactgggcttaacaactttgctgttaactcagtggtagatgtggaacatgacgagcagtttggatttacagacatagaagttcatcaaattttggatgattataagttaaaccagcatttttctgaaatgaaagaatggtatgacggttatcgttttggaaatgctgacatttactgcccgtgggatgtgattaatcacgtaaaaaagttactcattgatcctcaggcagatccacaggccttttggatcaataccagtggtaatggattggtcaaacgttttgtcgacaaggcagacaagacgacacgcgatgagattgaacaattgattgcaggaaatcccatcgaaaaaagaattcgtctggaactgacctatgatgagatagacaacagcatagataatctctggagtgtcctgtttaccacaggatacctgacacaagttgggaaagcggttgatggtgtttaccggctggtcatcccaaacaaagaagtccgtgaagtgtttgtgttccagatacaagaatggttccgtcagacgattgtagaagacgcaaaaccaatgcaggaactgtgccaggcatttttagatggggatgcagaaaaaatacaaaaacacctgacacagattcttggccggatgatcagtattttagataccaaagctcgtgacaaacaaaaggaaaacttttatcatggattgctgcttggtctgctgcggagtgaacgtgactggctgatccgctccaatgtggaatctggagacggtttctgcgatatcctgattgagccggaagatccggatgcgggaatgattatcgaattgaaatatgctgcgacattccgggaactggacagtgcctgcgaaaaagcaatgcagcagatcaaagatcgcagatatgacgaaaccctgcggaatgatggcagggaaaatattttggcatatggcatagctttctacaagaagcgctgcaaagtcatttgtgaaagactctaaagtatgtttttacatgccataattgtcagcaaaaatatatcactccagttccagtaacacccgacaatccttgcgcttgcaggcgataccgtattttaagatccggtgtacgtcctgctggtgcaacacgtttgtgtatcccgtttcgttgatctgctgaattgccttttggcattccgtttccaaatcatttttctcatcatattttacttcaatgataattccagtgtccgaatcatctatctggatcatgatatctgaaaaaccatttcccgattcccgattggatcgaaccatccacccgtccttgaaactaaggatacccaaaagcagcccatgatagaaattttctttcaaaggtttctgtacaaaagtgtcgcggacactgatagtttctgccatgtaggcgcgaaacagccgttctacttcttctggttttccatcatacaacgcggcacaaaatgcctttaccatttcgccatccttccggaccttttgtttaaaacgtgtcagaaccctgctgacaataacatttcgtatctcgcggtttggaataataagatcatacagttcgccatcctgtgagccccgctgagtaagatagcccgtcataaaaagcgcactccacagattatcaatcgaatcatataactcctgataggtcagttcttcatgaatttctttctgtattacatccccacaaaccagatgttccagttcacttttcgtcagctgtccatcctgatccagactatcaataaaatgattaatcacatcatttccgctcgtattgatccagtaattctttggcagggaattcgaatccatcaaatgatcactgcaatagttgattacatcccacggacaatatatgtctgtgtttccaaaccgatagccatcataccattcccttaccgtctcataacagtcatccaatgcataataatggagcatgccttttacttcggcattggtaaacccgaaatactcatcgaatgctacgtttgtgattgagttgattttaaagttattgagtccggtaaaaatgctttcctttgcaacacgtaagcagcccgtcagaaccgcgaactgaagggaagtattggtttttaatgcctggcctaaaagtcctcggatcatcgaaaccatttcccggtagtagccgttctggaatgctttatccagtggtacatcgtactcgtcaatgagtattactgttttctgtccatagtgctggtacaaaagttttgacagcaattgaatgctggatatgagaagttcttcctccatgacatattttccattgttcaaagcaatcaaggcacgatatttttctttttcatttgcagaaagccgatcgctatcgtttaaaaatgcaaatctttcagcttctgtaccgatcagctctgtcagacggtattttgcttcctcaaatgtcagtccttccacaccttttaaagaaaggaaaataaccggatatttccccatataggtatcacacagttctttgttgcctgaaatgtaaagcccatcaaacagagcaggatcagcacctatctcaaaaaagcatttcagcatgctcatgttcagcgttttcccgaaacggcgcggacgtgtgaacaggctgacttccccccagttctgtaaaagctgttcgattagctttgttttatccacataataaaatgcattcctgcggattttttcaaaatcatcaatacccaccggtaattttaatcgctgctccataaaaaactcccattcagctatcacgtttaatcatacccatagtatagcggattcctttccaaaatacaatttatttcgcaagtcttattttgttacttgcctgtcacttatgtgtgtattatatgttacttgccgcaatattttttcgttaaatcttttccgcaagtccagtattttcatcctgtttttcaacaataccagcggtattttccacggaagtattggaaatactggatttacaaatagttttttaggcgaaattatcgatacaagtaacaagcaatcaacagataagcgacaggcaagtgacaaattgtttcagttgtaatctctgtgccatatgctataatataggtagataaacaaaggattttaaagaaaggaatccctgcatttgatgacaaaaacaaatgatgacattcatgtaaatataaggacatcgtatttcaaaaactgtttggtgaaaacagagaaaatgcgctgagtctgtataatgcggtaaacggtaccgcatatacgaatccggatgatctggagtatacgactctggaagatgttatttatatgaaatataaaaatgacctgtcatttctgattgacaaaacattgagtctttatgaacatcagagttcctacaacccgaacatgccgctccgtggatttttgtattatgcagatctgtaccggaaactgatccaccgctctgagcggctgtacagcaaacatctgctgaaaattcctcgtccccactacattgtactttacaatggaaacgaaaaagacatggtggaagaacgaaggacgctgcgactgtcggatgcttttgaaacagatatcggagctggtgaatatgaatggacagctacaatgattaacataaacagtgggaaaaacaagttcattctggacagctgccatgttttatatgaatacgcagtatttattgcaaagatcaaaagataccgggattccatagaattaaaagaagccattgatcttgctgtcaggaaatgcattgaggaagatattctcagagactttttggaacagcatcgcagggaggtgtgtgatatgtgtctgaccgaatttgatgaaaagaaatatgaagatgtcctccgtgaggaaggccatgaagaaggccgtgcagaaggtcgcaaaacagaagtattcgtgtctgtacaggaaggcgattatggaattgcacgaggggctcaaaaactaaatctttccgtggaaaaatttgaaaaagaaatgtctgctgctggatatcagctcccagtagaagtgtaaaattgaatgataaaagaaacgccaacatcaagtttatgttagcgtttcttttgctttataggggacggttatttttgacacaatctttagagtttttcacaaacgactttgcagcgctttttgcagaaagctatgccatatgccagaatattttccctgccatcattccgcagggcttcgtcatatctgcggtctctgatctgctgcattgctttttcgcaggcactgtccagttcccggaatgtcgcagcatatttcaattcgatgaccattcctgaatccggatcttccggctcaatcaggatatcacagaaaccgtctccagattctacgttggagcggatcagccagtcacgttcactccgcagcagaccaagcagcaagccatgataaaagttttccttctgttcatcacgagctttggtatctaaaatactgatcatccggccaagaatctgcgtcaggtgtttttgtattttttctgcatccccatctaaaaatgcccggcacagttcctgcattggttttgcgtcttctacaatcgtctgacggaaccattcctgtatctggaatacaaacacttcacggacttctttgtttgggataaccagccggtaaacaccatccaccgcttttccaacctgtgtcagatatcccgtggtaaacagtacactccagagattgtcgatgctgttttcaatctcatcataggtcagttccagtcggatgcgtttttcaatgggatttcccgcaatcagctgctcaatctcgtcgcgtgtggttttgtctgctttgtctacaaaccgcttaactaaatcatttccgctgctgttgatccagtatgcctgtggacagacatctggctcctgcaataaatgatccacatgatttatcacgtcccaagggcaatagatatcggcatttccaaaatgataaccatcgtaccattcctttatttccgcaaagtgtccagacaaatcataatcttccaaaaggtcagacacctctgcatccgtaaagccgaattgttcatcatatcgtgcatcatcaattgacaggattttgaaattgttcaaaccagtaaaaatactttcctttgaaatacgtaaacagccggtcagaaccgcaaactgaagggaagtattggttttcaaagcctgccccagaagtccgcggatcagagataccatttcccggtaatagccattctggaatgctttatccagtggtacatcgtactcgtcaatgagtattactgttttctgtccatagtgctggtataaaagttttgacagcaattgaatgctggatatgagaagcccttcctccatggcatattttccattgttcaaagcaattaaggcacggtatttttctttctcatttgcagaaagccgatcgctatcgtctaaaaatgcaaatctttcagcttctgtaccgatcagctctatcagacggtattttgcttcctcaaatgtcaatccctcaacacctttcaatgaaagaaaaataaccggatatttccccatataggtatcacacagttctttgttgtctgaaatataaagtccgtcaaacagagcaggggcggttccgatctcaaaaaagcatttcagcatgctcatgttcagcgttttcccgaaacggcgtgggcgtgtgaacaggctgactttccccatgttctgtaataattgttcgatcaattttgttttatcaatataatagtaaccggatgtccgaatttcatcaaaaaattcgattcctacaggtaattttaatcgctgctccataaaagcctccaacctattcgttgcttcttctaatagttacagtatagcggattctcctttaaaatacaattttattgtaagcgatgaataacacaccgcctaccatattcctgaattcagttaaagcagtaaacgactaccatttactttcacttcctctgctacctatgcggcaggggaattctttttccggaacattagattccacatcaattagtcctgaacattgttcctttataaattcactccatttgctataactcccgcatttagatatttgtgtatcagtgaaattactctgacatccttgatgcttcgtgacaatacctcaatgagtttactctgacatactgtgtcgaagaacttttccaagtccatatccaccacatatacgtagccgtcatttacattcttttggcattgtctgagggcatcgtgtgctcctcttttcggtctaaaaccaaaactattctccgaaaattgttcctcaaagattggcgatagttcctgtgctattgcctgttgaatttctctgtcgacaacagtaggaactcctagctttcgaaactcaccttttgcttccttgggtatttctacccttcgaactgggttcggcttatatcttccttcccttatctcttggattagggtttcttggttttctcttaggaagggcagaagttcatccacctgcataccatcaattccaccttttcccttgtttctcttaacttgtttgtaggcttcattaagattgtcctttcgcaaaatcaaatccaaaagattgttcgtccaatagtctgtgatgacaccgctcttttcagtaatcttagagtagtcgaacacttctgcatagtttgtattgcaaccttatccttagctatagcctgatgtgatttctgttcgtcagaccagagatttgccgccaccttccttcagattcccctcacgttaatcataatcgctgctatgaataggacacccttggtcttggctgtatccttcccactactagggcggattagggactttcacccattagaaatgtgcaccgcaaggcgcacaattaaagaaagagagccgcgaaacgcgactctcttttttacctattcatcaaaccaaaattatttgattgtgattgctcctggtacagaaacttccatgtttgtataaacatttccgtcaacctttacagttacagcaagcttagtaattgtgaagtattcaccagatacaacagtctgagttccagatgtgaacttaacaccgttgttcttgataccttcaacagctgcaataactaatggctgatcagctgcggccttgtcagaacggctgctatatgttgtctcaccgtatgttacagtaagtgcattctttacagcatcagctacagtagcaccagctacagtgttatcctttacatcaacagaagccttatcctgagtatcctttacagtaaatgtagtagaaagctcaatatcttttccttcgttgtttgtgattgtagcctttacagagtatgttcctgtagcaagcttcttatcagcaacgattgcggaaccacttgttgctgttgtaatagcctttactaatacagcagaaccacttgttgttgttacaacagcatttcccttagcatcctttacagaaatggacttaattgtctcatacttaacatcaatgccatctttcataccaacaacctggattgcgatattcttatcagctgttgtatccttgtcaaccttcagatcgaaattgttgttatcaacatcaattctccaagcatcaggtacggtagtcttagcatcctttacagctacagaaacagtcttagcaactacttctttgttatcactgttcttgtaagaaatcttgtaaacatagtttccagcagcaacattttcactattgaaagttactttctttccgttgattgtgtaatatgtgcttccagctacagcagatgtgcttaagttagaaacatctgtagataagcactctacgcttaaattagcggcaatatcatcaccgtactgatcctttacagttgcagtaacagtctttgtattttttaactgcttagaaagagttacattgtaagaatctaactcaagtgttgcaacagttctttctgctacgatttcaacagctacagaaccaacaatcttgttatccttcttaataaggatgtaagcagtaccagccttaacagcagttacgtttacactgtgcttattaggatcaagagtagatgttccaagcattaatgtagccttgtcagaagactctactttatatttgttgtaatctttgatctcgttaccgtttgcatctttaatcttaaggaatgcagcgtactgtgttggatcctttacagcaagcttcttagaatccttagccttatcgaacttagttgtcgtagccttgtcaattcttacatcaaatccgtttacaacagcctgatctacagcagtaattgtaaccttgtttggtccgatgtttccttctgccttaccattctggtcatactttcctgtcttgtactcgatcgttgcttcagcagtatcgtttaccttatttaagtataacttagaaccgtttgtatatccatttccctttgtatcaattgtaaatgtataatgagcatctgcatctgttgtcttcagctcttttaatacaacgccgttagcatctttagaaacaagctttacttctgtctctgttgcatatgggattgttgcgttatcaagtgcgatagaagcaacctttccatcagaagccttgaaagactttgttgttccgtcaagtgtcacatcatagttagcaccatcgtttaactcgctgaacagtgttaatgtaacctttgttgcatccttagaatcaacagataccttagataccggataaacaacatttgaagttgtattctttactgtgaaatcagtggtcttaaggttctttgtgtttccagcaacagtagcggtaagctctgtaagctttgtctgggaaactgtgcctaatgcgtagttcttaacttcaacttcagcagtagtagaagccttatctgttgcagctgtgattgtaaccttgccagtctttacaggtgttaccttgccagtagtatctacagttgcaattgctgaatcactagaagtatatgtgactgcagcctttgccggtgctgtctttgctgtgaactgtacaggtgttcctacaacagcgattgttgttccggaaacagttgcaccagttgcatctacaagacgaaccttgtaattctttacagtgatgttagatgcaagagtcttagaaactttcttgccattcttctttgcagttaccttaaccgtaacttttgccttaccagccttaacagcggtaacctttaccttctttgtagaagtctttgatacctttgcgatgctctttgcactgctagaaactgttgtcttaacactcttccagctagaaggtgtagtaacagttaatgtttttgagctaccaacataaacagtagccttttttgcgctaagctttgctgtagaagctgcctgtgcgtttgtagcaggaactgctgttacaaccatagctgcagcgagagcaaaagctaacacttttttgcttgatttcatgttttttcctctctttctttttgactaacttccatctcttctactcgtttaaccctgcacgtttaagttccttcatcttctcttccaaaccgctgcggacgatttttccaatccaatgttctcgctaattgcctccactgaccttcctcggtcttactgttaagtccatcgtcagtttcatctgcagacacacaaatcataaatgaccagaaactttcgtacatcagacgtcggcgtagagtgtgatatcaacgttgattgtccagcatcaagatcagcaagctgaggttccgatgacttatatttctaatatgtatctgtaattgtaaggtctgtctggaacaagttccagtttccatagcctcgatagtagttcatcacttgtcgtactatttatagtactcttttaactactctacgtgacaatcatacaccaagtattgtatctttgcaacaccaaaattacattttattgaaaaaattctttaatattttcttaagcatttaagagttttttcacttttttctattattaaaactatttcacgcgtagttcgagtgaagctacgcgtgaagataaacaattctatttaaagtaagcaactccggattcgaagatcttcatatcctgctctccgtagatgttcatggcaacggcctcaccgcggcgctcgctgtgtgccatctttccgagtacacgtccatccggactggtgataccctcgatcgccatgtacgaaccattgacattccactcttcatccatggttggctcgccggcttcattgacatactgggtggcaacctgtccgtttgcaaaaagcttgtccagccattccttcggagctacgaaacgtccctctccatgggatgccgggttgcagtatgttgcaccaagctttgcctgctgcagccatggggatttgtttgttacgaccttggtatataccatcttgctgatgtggcggttgatggtattgtaggtcagtgtcggggaatccgcactctgtgcctggatctgtccgtaaggaacaagtcccagtttgatcagcgcctggaatccgttgcagataccaagtgccagtccgtcacgttctgacagcagtctgcttactgcctctgtcatctttgcattccggaatgctgttgcaaagaactttgcagatccttccggttcatctcctgcggagaatccacccgggaacatgatgatctgtgactggttgattgccttgacaaattcatcgacagaatcacggatgtctgctgcactcagattcttgaatacttttacaattgtattggcacctgcacgttcaaatgctttcgcactgtcgtactcacagtttgttccagggaataccggaatgaatacggtcggctttgcgactttgtttctgcatacatagatgttctttgtatcgtatacgtcactctgtactttttctttatcctcggttgcgcgggttgggaatacacgctcgagtgttccctgccatgcatcaagtgcctcatccatggaaagagccatgtctttgtatacgaatttctgtgcgtcgttcacttctccgataacgattgcggatgcttcttttataataggaagaaactcttcttttacttctgctacgatattaccgaatcccggtgcaaataaggtttctgcagtgacatcatcggcaattgtcacacccagtttgttaccgaatgccatcttgctgactgctgctgccagaccttttccgtcaagtgcataggcactgcggattgcacccttgccgatcagctcatgaatcttatcatacagtttcatcacctgttcatataccggcagatcatacgcgttcttttcgatcgtaaagagtaccagcttatctcctgcttctttcagttccggtgtgatcacgtctttttctcttgccacatcgactgcgaaagaaaccagtgtcggaggcacgtcaatatcgttaaaggttccggacatggaatcttttccaccgatggacggcagaccaaaaccgatctgtgcatcaaatgcaccgagcagtgctgcaaacggctgactccatctctttggatcttcactcattctgcggaaatactcctggaaggtgaagcgtactttcctgtagtcaccaccggcggtcacgatacgggaaagggattccagtacggcatataccgatccgtggtatggactccaggaggataagtacggatcaaatccgtaggacatcatggttacggtatcgcattttcctttcagaaccggaagtttggcaaccatgctctgtgtctcggtcagctgatagcggccgccgtatggcatgtagacacttcccgcaccgatggaaccgtcaaacatctcgacaagtcccttctgggaacatacattaagatccgcaagcatggcaagccatgctgatttgttgtcgtttttctgtaatgcatctgcaactttcggaagttcgatctttttaaagaagttgtcttcctcttttggcatctcgacttcgacatctgcttcctgatgcgcaccgttggtatcgaggaatgcacgggaaatattgacaatgtcttttcctctccactctaagatcagtctcggctcctcggtaacaactgccacctcggttgcttcaaggttttcttcttttgcataagcaaggaactgctcgacatcctgcggagcgacaacgactgccatacgctcctgggactcggagattgcaatctccgttccatccagaccagcatatttcttcggtactttatccagattcacgcgcagtccgtctgcaagctcaccgatggctaccgatacaccgccggcaccgaaatcgttacattttttgataatatggctgacttcttctctgcggaacaggcgctgcagtttacgctcagtcggtgcattacctttctgtacctcggcaccacatacagacgtagactgtgtgttatgtgccttggaagatccggttgctccaccgataccgtcacgtccggtacgtccgcccagaaggataatcttatctcccggatcagaggtcagtctctgtacggcacgtctcggtgcggcacccatgacagcaccgatctccatacgttttgctacataatccggatgataaacttctttgacatatccggttgccagtccgatctggtttccataagagctgtaacctctggctgcctcgcgcacgatcttcttctgtggcaacttaccctcaatcgtatcttttacggatacggttggatctgcggctccggtcacacgcattgcctgatacacataagttcttccggaaagcggatcacggatggctccgcctaaacaggtagcagcaccaccgaacggctcaatctcggtcggatggttatgtgtctcattcttaaagtttacaagccactcctctgtctttccatctacatccaccggtaccacgatggaacatgcattgatctcgtcagattcttcctgatctgcaagttttccttcttttttcagacgtttcatggcaagcagtgccagatccatcaggcagacaaacttgtcatcgcgtcccgcatacagtttcttgtgggtatccagatattcttcgtaagtctttttgattggtgcctggtaaaatccttcatcaaacttcacatttttcagttctgtcgagaaggtggtatgacggcaatggtcactccagtaagtatcaagcacgcggatctctgtcacggacggattccgcttctcggtatttttgaagtaattctggatatgtaagaaatccttaaaggtcatggcaagatttaaagagctgtacagttcctttaagtgtgcttctgccatgtcgataaatccgtcgaaaactgccacgtctgccggctcatcgaaattctgtacgagggtatccggcttgtccataccggtctcacgggaatctaccggattgatacaatactttttgatcgcctctaactcatcctctgtgatgtcacccttgatcacataggtcgtcgcgctgcggatgatcggctcctcatcctcatttaaaagcttcacgcactgctctgcggaatccgctctctggtcgaactgtcccggcaggaattctacggaaaatacgtttccgccttctgcgtcaaagttctcctcataaatatcatccactggcggctcggaaaataccgtctgcaatgccttctggtaagtggcatccgatacattttccacatcataacggatcagaacacgcacctgatctgcagcgattccgagataatgctttacctcatgttttaattcttttgcctttacggcaaaatccggtttcttttctacgtacacacgacgtacattgcccattggatttacctccttcttttgcgaaacggaatgccccctgcatttgggggcattctattgatctttatgttattgtatcatgggttgacaattaagtaaaattaatatcgcttacgatatctattacctgttcttatgaaattactgtacggtaattgcactgtccgttacaacgcccggagtgtccggttccggctgatccggctgatcggtacccgggtttggatttacaaaattaatctttactttcagctttctggatttatttcctgccgtatctttggcatatacggtcacgctataagttccataggttcctctttccatagcggtaactgccttatgtgcttctctggcatccacgaaaacatattttgacgcaagttttttgcccagatcttttgccactacatctgccttaattgcagaaaccagtttttctttggaaacggctttattgtaggtcagtgtctttcgcttcaggctgatggatggtgctttcgtatcttttacggtaattacgatgctcttttgggtcttgtttcctttggcatcttttgcggtgtatgtaatcttatattttccggtctttgccgcattgacttttccggaaacggtaaatttaagtgtcttacctctgtaatcggtagctttcacaccctttttcagatctactttgctgtttgttctctcgatggttttattcttgattcccttaatcgtcggacggagtttcagccatggatttctcggatccggatcggttggatcccatccgcggtatgggctgtttacatcgatgcggaccggagttggctttccgagtggtcccggatctttgctgtcatagatggttactttggttcctaccgggcagttgtcatagatccacttggcatcttccacattcagacggacacatccgtgggatgccgtctgtcccagacggttataagaattgtatgccagcctgctcggatcctgtgaactgtaaaacacagagtggaacagcacaccaccgtgaatacggctgcaatactgtccgtacacaccgcccataagtgtatgccagcggtattttgccggaatcgaaaatgttcctgtcggggtggcattgttgacaccgacagagcaggcaaatgctttgaccggtttggtatatttgcctttggaatcaagtgcatatacggtcacacagttctgctgacgattgattttaatgtaatatggcagttttgctgcctgagttgtaacgggtgttcctgcgaacacaagcagcatgagtgccgccatcaatccgcataaggttttcaaaattccctttttcatgataatctccttttctctcctttgtgaaaggtatataatatatcctatactatactatactatactactgaggatatgatcgatggatatcaattatgaattatacaaggttttctattatgttgcaagctctctctcattttcggatgcaagtaagaagctgtttatctcccagtcagcggtaagccagtctatcaaaacactggaacgcaagctgggacagccgctttttatccgcagcacaaaaaaagtgcagctgactcctgccggtgctctgcttctgaaacatgtggaacctgccatgaatctgatctcacgcggcgaaagccagcttttagaatccggctctcttggtttaggacagctgcatatcggtgccagcgacacgatctgccgctattttcttctgccgtatctgcagaaattccatcggaaattcccggatgttccgattaaaatcaccaatgccagctcgatgggctgtgtagacctgttagagcagcgccgggtagatctgattatcacaaattttccaaacccgcatctgaatccttcctatattcaaaaaacggttggctctttctcggatgtgttcgtcgccaatccggcatattttgatctggcggaccgcatcgttcctttctcggaacttggcacctatccgctcatgatgttagaccgcaagagcacaacgagtgagtttctgcaccacattttcctgcagcatcagctggaactgctacctcaggtagagctcagcagcaacgatctgctcattgacatggcccgcatcggtcttggaattgcttttatcccggatttttgtctgaaacacaagccggaggatctcttcctcgtccgcacgcaggaaacgatcccgcagcggcagctggtggcttcgttaaaccctacccttccggtttctgcctccaccgaagagtttttaaagctcctcccggacgtctgaccagaaccggctcacttcttcccgcagctgcggcagaccacagacgcttctcttttcccattctctcggaaaaagcgctccgtattcgcgctgcaggaaacgttcatccagcagaaggatcacgccgcggtcctcgctggtccggatcacgcgccctgctgcctgcaggactttgttcattcccggatagcggaacgcatagtcaaatccggacaatccccgctcatcataataattctttaaaatttcacgttcatcgctgacctgcggaagtccggttcccacgatgatggcaccgatcagccggtcgtttttcagatcaatgccttccccgaaaattccacccatcacacagaacgcaacgagtgtcccctggcgctctttttcaaattcttccaaaaacgcttctctttcgtgttctttcatattagtatgctgcatcagaatctcgcacgaatcggccgccttcccggcaaagacctcatatacatcctgcatcagccggtaagacgggaaaaacaccatgtaatttccctgctgtgcttctgtgactgcaccgatatagtccgcgattttttcgtattcttttctgttcctccgcgtatattttgtgctcacatcccggccaaatgcgagaagtctctgtgtctgggcaaacgtactctgcgcataaatggcatagttatcctcgtccgtggaaagtagccgcttgtagtatccgatcggcaggagcgttgcggagaaaaagatcgtggaattgcttttatcgatgcatttctgcagattgaccgacggatctacgcaaaagagccggatccggaactgaccttcctccgtcatctggctgtagatcacgtaatggtcatccaccagatcatagatattcaggaaattgcgcagcgcaaagtaaaaatccagcaccgttttcttctccggaaattcccgcggtttttccaaaaattcatccatctgggaggccagccgcataaggtggaaggtcaacgttcccacactgtccagaatctggtagtgctcacactcacgtttcatttccagcatggctttgttgcatttgtccaggatacggcagatcgtacggctgtgcgctttcatgatccgcttcactgcaagcacgtcttctttgtacagatcggcactgtacatctccctgctgcgatccacgaggttatgtgcctcatccaccaggaacagatagtctccctttatcccctcctgaaaaaagcgtttcagatatacattcggatcgaatacgtaattgtaatcacagacaatattgtctgcccaggttgccacatccagactcatctcaaacgggcacacctgatattctttcgcctgcgctaaaacttcctctctggtaaacaggttggatttctgcaagagatcaaacaccgcatcgttcacccggtcaaaatgcccctttgcatatggacagtttaccgggttgcagtccatctcttcacacaggcagagtttttctttggctgtgatctggatgactttggcacggtatccctgttcttccaacagggcgaatgtttcttttgccacggttgccgtgatcgtctttgccgtgagataaaagatccggtctgccagcccttctcccactgcttttaccgccggaaagattgtggaaattgttttgcccacaccggtcggtgcctcgataaacaggttctttccccgcagaatggtgcggtaaacatcggcaaccagcttcttttgtccctgccggtaggaaaatggaaactcaagtgtatgaatactctcctgccgctgttttttccatgcgatctgccagtctgcccatttccgataatcttcgatcagatgcgtaaaccacacggtcagtgtctcaaatgtataaatttcccggaaataccgaatttcttccgtatccagattgcagtaggtcatctgcacgccgatccgctccagacggttctgtttcgcatagatatacgcatagcacattgcctgggctttatgcacgtagaccggctgttccattgccgcaacgtttctatatacacccttgatctcatcgatgaagctgatttcttcttccggagggatttctgccgcaaactccttctccggttgcagcacagactccgtcgcagccggcagatccggctgaaattttccataggcgattccgtctgcacgtccttccacgaccagtatgtaatcgttggctttccattcaattttcagcggtacttccgcctgataggaggcgtccatgcttttttgaattttccggtggatacggctgccttccatcatggcctctgcactcgccagctttcctgcacggttatcgatatctcctccacggaaaataaactctaccagatttctcacagatatatgtaattcctgcatgtacacctcctttctcccgcgggtattttcctgttgtatgaagcgggtttttattttgttccattattttacaataaaaagccccgctccggaatacggagcgggacttaaagttccatagtcacgatataataattgtattatgccactgcaaatttagcaactacgttttcgaaattttcattctttccaccgtagcaaacctgaagattcttttttacgccaagtccaatcataccaagcaatgactttgcatcaatgaatgttctgtcacattttacatcaatatcaaaatcacaaccacctgctgcacgtacgaaatccttaacttcatccatatctgataaccgaattactttaacagtttcatacataatccaacacctctttctacctttaaacaacatacttttattatcatccccaagtttagaaaagattatgccactttttttctcatctgtcaaagttatgcaaacttcgcatttctccggtttttcctgcataatgacggtaatcgcgcaaccgtttccatcagattcttaccgttttttttcgtgtatttatatttatacctgctatcttatgcaatttctccaaaaaattgcctttccaatcaccaaaacaagcattttttgatgaaaactatttttatcaaagtggtttcccactttttttcagaatatccacatataattctccgatcggactgacctttatccccttgtgccggatatagccgatccgcatcttttcgctctctgccagcggcactgccgcataatcatttccgtttaattcttcacagataatcccggaacagagcgtataaccattcagcccaaccatcagattcagcatggtcgcccggtcatccgcatggatcatcttcttatattcataggtacttttcatctcttcggcaaaataaaaggaattatttttcccctgttcgaacacaagacatggatattcctgcagttctttcatggaaattacatccctttgtgccagcggatgtcctttccacagatatacataggtgtcacaggtaaacagttcttcaaaaattacatcattttccctgaaaagtttctggagtactgcttcattaaatttgctcaggaaaagaatccccagctcacttttcatgttgcgcacattttcgattacctgattcgtctgtgtctcatgcacggcaaattcatattcttccattcccaccgccttgaccacttccacaaatgccttgaccgcaaaggtataatgctgcatcgacacggaaaatttctttttggatgcagacgaaatataacgggattccagcaaatgatactgctccacgacctgcttggcatatccgataaattcctctccctctggtgtaagcacgattccccggttggaccggataaaaatggtgattccagcttcttcttccagttcgcgcacaaccgcagacagattgggctgtgagacaaacaattttcgggatgcttcgttcatggaacggctttctgcaatcgtaattacctgatgtaactgctgtagggtcatatgtcttacctcttttccttaatcatatgatctgttatataccggacaaggatctgaagtatccatgcaatcacaatggaactgcataccagcaccagttcgtaacgcagatggcatgtatgaaatgctgctcccttcataaattttcgtatggtaacatgtaccagatacaattccagcgaatgagcaccaaaccattccagtattcttataaccgggcgcatagataactgggaaaagatccaggcaattcccgcacaacatgagatattaaaaattccagtcacataccttgcaaaaataggagatccacttggaagcatggtgagcaaatagccggataacgcaaaaagaatcaaccatttccaataactttcccttttttcatagctggatctgccataaaaacagcccgctataaaaacaggcagacgaagcaaagcaatatttacatttccaaacatctctttctcatataatgcaattacaagtgccaatacggtaacagcacttaccatggaaatcagccggatctctccatctattgcgtcccgtgcgctatccacaatctgaaagatatagggataaatcaaatagcataacagcataagtccaatataccagtaaagcctgtctccattactgaaaaatgtgataaatgtgaagtcttttatggcttctccccatcctgttttatttacacagacatccagtaaaatataagagggtacggctacgatgcaataaggaatcaggattctttttaatcttcttatgtaaaaacttctaacatctgatctttttttcatggaatagtataaccccagaccagaaaagaataaaaaagcatccacacttgatgatgaaatatatctccaaaagaaggaaatccagccactaaaatgataggagtaataatgacagtcatccgtaaaatgaaaaactataatcaatatgatggatattcccattaacgcaccccgatattgcgaaagcacgctgttacttgtttttctcatatatattctcctctataaaaatttaatttaaattactataaataaaaaaacacctaaacaggtgtttttaaagaacaggggatgagagaatcgaactcccaccaaaggttttggagacccctatcataccatttgaccaatcccctatatgagaaaacaacgtagacaagtacgctgctaacttcttattcatgaaatgtttgtactttcaaaacttcatacagatttaaccgcttttttaatcaagccctcgacctattagtaacagtcagctccatgtgttgccacacttccacctctgccctatctaccttgtagtcttcaaggggtcttactcccgaaggagggatatctcatcttgaggggggcttcacgcttagatgccttcagcgtttatcccttccagacttggctactctgccatgccgttggtcgacaacagatacaccagtggtccgtccatcccggtcctctcgtactaaggacagctcctctcaaatatcctccgcccgcgccggatagggaccgaactgtctcacgacgttctgaacccagctcgcgtaccgctttaatgggcgaacagcccaacccttgggacctgctacagccccaggatgcgatgagccgacatcgaggtgccaaaccactccgtcgatgtgaactcttgggagtgataagcctgttatccccagggtagcttttatccgttgagcgatggcaatcccactttataccaccggatcactaagtcctactttcgtacctgctccacccgtcggtgtcgcagtcaagctcccttctgcctttgcactcttcaaatggtttccgaccattctgagggaacctttgagcgcctccgataccctttcggaggcgaccgccccagtcaaactccccgcctgacattgtcccactgccgggtcacggcagctggttagaaacccagtactacaggggtggtatcccaacagcgactccctacagactggcgtccatagttctcagtctcccacctatcctgtacgtgcagtaccgaatcccagtatcaaactggagtaaagctccatggggtctttccgtcctggcgcgggtaaccagcatcttcactggtacttcaatttcaccggatgcattgtcgagacagtgctcaaatcattacgcctttcgtgcgggtcggaacttacccgacaaggaatttcgctaccttaggaccgttatagttacggccgccgtttactggggcttaaattcaaagcttcgcttacgctaacctctcctcttaaccttccagcaccgggcaggcgtcagcccatatacttcacctttcggtttcgcatagacctgtgtttttgctaaacagttgcttgagcctattctctgcggcccaccatccagtgggcaccccttctcccgaagttacggggtcattttgccgaattccttaacaatgcttcttccgtcggccttaggattctctcctcatccacctgtgtcggtttacggtacgggcacatataaaacaatagcggcttttctcggcacatggctcacatacttcactacttaatttcgctccacatcacgtcttcggcttatatgacggatttgcctgtcacacacctacctcgcttgtaccggtctttccattcccggcttatgctttccacatgcgtccccacagttctgtttatatgcggtacaggaatctaaacctgttgtccatcggatacgtcttgcgacctctccttaggccccgacttacccagagcagatcagctttactctggaaaccttagatattcggccggaaggattcccaccttcctctcgctactcattccggcattctctcttcttatccctccactgctccttaccggtacagcttcgtcggttttaagaatgctcctctaccactccttacggagtccacggcttcggtgttgtgtttcagccccggacattttcggcgcagggactctcgactagtgagctgttacgcactctttgaatgtatggctgcttctgagccaacatcctagttgtcttcgaattcccacatccttttccacttaacacacactttgggaccttagccggtggtctgggctctttcccttttgaccgcccaacttatctcgtgcagtctgactcccgttcatcatctacatggcattcggagtttgatattctttggtaagctttgacgcccccgcggaaattcagtgctctacctccataagactaaaacgaggctagccctaaagctatttcgaggagaaccagctatctccgggttcgattggaatttctcccctatccacacctcatgcccacccttttcaacggatgtggcttcggacctccaatgccttttacggcatcttcatcctggacatggatagatcacccggtttcgggtctactcgtactgacttaccgcccagttaagactcgctgtcgcttcggctccgtgccttaagcacttaaccttgccagtacgcgtaactcgccggaccgttctacaaaaagtacgcggttggtcatataaagaccttccacagattgtaaacacagggtttcaggttctctttcactcccctcccggggtccttttcacctttccttcacagtactatgcgctatcggtcactaagtagtatttaggcttacggggtggtccccgcgtgttccatcaaggtttcacgtgtctcgatgtactctggataccgccttgtcagttttcctttcgcttacggggctttcaccctctccggcaggctttcccaaaacctttctgctagaatcactgaatcaattatgcggtccgaaccccgctgtgcacgcacaacggtttggcctctttccatttcgctcgccgctactctggaaatcgatgtttctttctcttcctccggctacttagatgtttcagttcaccgggttcccttccatacgttatggattggcgtatggatgactggagtccttccagccgggtttccccattcagacatctgcggatcaaagattatttgcatctccccgcagcttttcgcagcttatcacgtctttcttcggctcttagtgccaaggcatccaccctgcgctcttttttgcttgattattcaatcctcgttatcatagcgttgataactttcgtaaccaacttctggtcagttacttattattcattaaagaactttacggttattacgatgtcttgatcaaatagatatttaatcatcttatcattctgtatgaagttttcaaagtacaatgttttgactgaagtttttatcagtcatcagaaatcttaatcttttaaaatctctgatcgctggtaaaatcttttttatcaatctggcagccacctactttcccataccgttaccagtatagtatcatcggccgcttaagtcttaaccatcgtgttcgggatgtggacgggtgtttcccctaagcgcatcgccaccagaaacatgaagtattgtgcaagcaataaggaatcctcccacaagtgggcccctccttgttgcaatcaataactcaacagtgaaaaatccctactcgatttccttagaaaggaggtgatccagccgcaccttccgatacggctaccttgttacgacttcaccccagttatcgaacctgccttcggcaactccctccttgcggttgggtcactgacttcgggcatttccaactcccatggtgtgacgggcggtgtgtacaagacccgggaacgtattcaccgcagcattctgatctgcgattactagcgattccagcttcgtgtagtcgggttgcagactacagtccgaactgagacgttatttttgagatttgctcggcctcacggctccgcttccctttgtttacgccattgtagcacgtgtgtagcccaagtcataaggggcatgatgatttgacgtcatccccgccttcctccaggttatccctggcagtctccctagagtgcccggccgaaccgctggctactaaggacaggggttgcgctcgttgcgggacttaacccaacatctcacgacacgagctgacgacaaccatgcaccacctgtcaccgatgctccgaagagaaagtacattacatactctgtcatcgggatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagcaatgctccccgacacctagtattcatcgtttacggcgtggactaccagggtatctaatcctgtttgctccccacgctttcgagcctcagcgtcagttatcgtccagtaagccgccttcgccactggtgttcctcctaatatctacgcatttcaccgctacactaggaattccacttacccctccgacactctagtacgacagtttccaatgcagtaccggggttgagccccgggctttcacatcagacttgccgcaccgcctgcgctccctttacacccagtaaatccggataacgcttgcaccatacgtattaccgcggctgctggcacgtatttagccggtgcttcttagtcaggtaccgtcattcttcttccctgctgatagagctttacataccgaaatacttcttcgctcacgcggcgtcgctgcatcagggtttcccccattgtgcaatattccccactgctgcctcccgtaggagtttgggccgtgtctcagtcccaatgtggccggtcaccctctcaggtcggctactgatcgtcgctttggtaggccgttaccctgccaactggctaatcagacgcgggtccatctcataccaccggagtttttcacaccagatcatgcgatcctgtgcgcttatgcggtattagcagtcgtttccaactgttatccccctgtatgaggcaggttacccacgcgttactcacccgtccgccactcagtcacaaaatcttcatttccgaagaaaatcaaatagagtgcttcgttcgacttgcatgtgttaagcacgccgccagcgttcatcctgagccaggatcaaactctcatgttaaaaagttttgtcctgccagaattaaatctggcttttaatcagaaacaatgtcctgatttactgttttaaggttgcttctttatagaagcgttcttgaattattctcaaaatctttcaaggtttttcactgttcagttatcaatgttcgttgttgttattttcaacagcttgtatattttatcatgtttacaagtcgttgtcaacaacttttttattttttctttgttgtcgttctttcgcggcaactctgatatcttatcatgtctgtcgctttttgtcaacaactttttctcggcaatttattctgtcggagctcaatatcacttggctttatccgatcagaactgctctgcacgagtcagctttgttataataccacccggctcgaattttgtcaatcagaaattacaaattaaattatattcagacaatttatgttgtattctaaaattgttatatcatgctttttatttttcacacaatacaagaaattcatataacatagcctatgcctgaattgcatccagtgcctccctgacatttgccaccccgatcagcttcattgcatacttcttccctacagaaggaagggatacttttggcagaatgcatacttcaaaaccaagtttggctgcctctgccacacgttgttctgccatgcttacaccacgcacttccccgcttaatcccacctcgccaaaacagatggtcttctcatcaatcgtcagatccagtttgcttgacataatggcaagcacaattcccagatcaattgccggttcattcatacggattccgcccgcgatatttacataagcatcacaatccgacaactgcattccaatacgtttttccaaaactgccatcagcagattcacgcggttaaagtccgttccggtcgcagttctcctcggattgttgaaatagctgtgacagatcagcgcctgaatttccaaaagaatcggacgggtaccctcgatggaacatgccacgacagaaccggaagcatcctttggtttgccgctgagcatatactcggacggattctccacctcaaccagtccctctgtgcgcatctcaaaaacaccgatctcgttcgtggagccaaaacggttcttcacgccacgcagaatccggtagctttcatgacggtctccttcaaaataaagaaccgtatccaccatatgttccagtacacgtggacctgccacgaccccttcctttgtcacatgcccgacaataaagatcgagatatccattccttttgcgatctgcataagaacacctgtagactcacgcacctgtgacacgctgccgggcgccgaggaaacgttttcgttatacatggtctggatactgtcgatcaccacaatctgtggcttattccgttcaattaccgtgcgtatggtgtccagactggtctcacacaacagttccagatgatcactgaacgtgccaatccgctctgcacgcagtttgatctgctgcagggactcttccccggacacatacagtaccgaaagattctgcccggacagattccggcagacttgtaataaaagcgttgatttaccaattcccggatctcctccaaccagaacgagggagccttttacaactcccccgcccaatacacggtccagctccggcatggatgtggaaatccgctcctcatccgatgtctttattgcagaaagcggaacaggtttcgcttctgtcgctggttttatttttccggaagtactgagtgctttccggtccaccagttcctctacgaacgtgttccactctctgcatgccggacactggcccatccatttggatgattcatatccgcaattctggcaaaaaaacgcactggtttttgcttttgccatatattatctcttttctacgcggattgctaccgcatctgctccttctaattctacgctcaggcttaatttgcctccaagattggtcttcattgttcctgcggacttgccatcgatatcaatctcgtactctgtctcttctgccagctccaatgtgatctgtgcatcttccggtccctctaccgtaaagctgacagtattctcatcctctgtaaaattggtgacagctgtacccggtacagattcatatacaaacagtccgttacgctccagctttgtaatctccttgaacgtttttactttgtatttatctccatgaaattcatagttatcaagctttgctttcgctcccagagtgtaatcgccgaaactaagggttccgtttccttccgtacgaattaattcactgattgcagccatgatttttcctcctgtgtggttgattatttggttcttaaattatatcactttttatcttttgatacaatgatttccttgttcttcgtcgtcacgatcacacggtccccggtatggatttctccacggatcagtgcgtctgccaaacggtcttccacctcatcctgcagttttctgcgcagaggtctggcaccgtatttgcggtcataagctttttcaacaatatattcctttgcagcttcccgtaccaccagatcgatctgtaactgttccttacagcgtttctgtaaatcacgcaccataatgccgatgatttttttcatatcgtctttgttcagcgcacggaatacaattgtctcatcaatacggtttaaaaactccggtttaaaaatacgtttgacttcttccatcacgctggctttcatccgctcgtgatcctgcttttcatcttcttttgcaccaaagccaagcttcttcggctcgatgatcgactgtgcgcccgcattactggtcatgatgataatggtattcttgaaatctactttgcgtccctgggaatctgtaatatgcccgtcatccagcacctgaagtaagatgttaaacacatccggatgggctttttcaatttcatcaaacaaaatcacagaaaacggatttctgcggactttttccgaaagctgtcctccatcctcatggcccacatatcctggcggggagccaatcattttggatacactgtgcttttccatatactccgacatatctacccggatcatggattcctcgttgccaaacacagcctctgccagtgctttggaaacttccgtctttccgacaccggttggtcccaaaaacaggaacgaaccgatcggacgcttcgggtctttgagtcccacgcgaccacggcggacagccttggaaactgcagataccgcttcttcctgtccaatcacgcgcttgtgcagtgtttcttccagtttctgcagacgggatgcctcgctttctgtcagacggctgaccggaatctttgtccatccagccaccacatcggcaatctcattttcgcccaccaccggaactttgtttttggatacgcggcggttctttttttcgagtttttccctggatgcctgcaggttctcccgtgtctctttcaatgtgcgggctttctcgatatctccctcctgcagcgcatgctccatatccagttccgtctgatggatctcacggtttaactgcatcatctcatccgatccatgcatcattccaagccgtgcttttgcagctgcctcatccatcagatcaatcgccttatccggcagaaaacggtcattgacataacgggcagataaacgcacggatgcttccactccctcatccgtaatctgcacatgatgatgcttttcatacagctttcgcagcccttttaaaatctcaatggattcttcctctgtcggttcctccacctgtaccggctggaaccgccgctcgagtgctgcgtctttttcaatatacttgcgatactcttcgatcgtggttgcaccgatcacctgcacatctccgcgtgcaagtgccggttttaaaatattagacgcatccagtgcaccttctgctccacctgcgccaataatcgtgtgcagttcatcaataaacagcagcacgttcccagccgtctccacttcatttatcacttttttaatacggtcttcaaattccccacggtatttggattttgcaacgagtccggacatgtccagagataccagacgtttatctgccacaatatccggtacgtttccgtttaccagactctgtgcaattccttcaacgatcgctgtcttaccgacacccggctctccgatcagacacggattatttttgcctctgcggcacaggatctggatcacccgttcggtttccttttccctgccaattaccgggtctaaccgtccggcccgcgccatagctgtcagatcgcgggaatactgatcgagcgtaggggtaagtgttgcctcctcatttcttccacgcttgatttcttcccggtactgtgccgggtcctctcccatcgcagcaagaatatccacaaaaagtttctgtgggttggctcccattgtatttaaaagccgggaagctgcacaatccccctcttttatgatggcaagcagcaggtgttcggttccgatccgttcactgtcaaaacggtctgccatctccctggcacgatccagcaccatctgggtacgcggagaatatccgtcacggtctgccaccgtcacctcctcacctgccgcaaccagttcatcaatcagcttaagcagcgcttccagttccacattattggctgtcagtacttctgctgctacaccggttccttccttgagcagccccgccagaatatgttcggttccgacatagttgcagccggacgaacgggaaaggcggttcgcataattcagagcttttttcgccttatctgtatatggaatcaaaatttatacctcctgttacaattctacaaatcaataaattcgatatcgtcatcggtatcttttttggttgttttcttctttcttccgagcacggagcttcgaacttcttctgccagttctttctgcagcatgatatcttcatcatctgcatcccggtaatggtcctttcgcttctcccgctctttttccctgtcatcggtatcttcttccggatcatcatccaggtcatcctccagatcatccaggtcatcctccagatcatcctcaataccctctaacagtttatgcataaatccgccttttttgcggaatgtttcctttccgtaacgcttggatatcccggtgtcatccggatcatccgtttcatacagtttttcatcgtccggatcatcgtaatcctcatcgtcgtcatcatcatcgtcataaaaatcatcataaagatcgtcatcatctttttttcttttgacgatcagaaccactatgataatcagaagaatcagtacaaccacaacgaacgcacagagaatcagccgcatctggctttccgtactctggaacaggcccgtttccccttcctgggtagaagcttctgcagatgttgtctcttcccctatggtatgcttatactggttatagttcatacatacaaacggataaatttcttccggatcatccagatccagcatatacaaagcaccgttttgtccgttttcatccaccagatacaaaagtctcagcggtgtgtctattccgtctttgcgcatgcacggatactgattttcccacaaagtcactgtatctttgacaaagccatccaaaacatagcgatccggaatactgtctgtcagatagagatttgtttcgtcaatcgtaaaatactgctgcccgtctgccggagcctgtgtctctcctttttgctgtgtatcctgtgattcctgctgcgcagctcctctggtcacctgaatggtataggtctttttcacaccattttccgcctgcacgacgatctgtactttatttacaccggttttcagtttgtctgccccactgaccgagatcacagatgccttagcatcatttggctgtgcgctgactgccagcgatgtcacctgatctcccacttttgcctgatattcggtaactttcgactgaaattccggagaaagggttccttcggaaatcgtcagggatgccagcgtattgtcttttgatttgtcatctgctgccgctgccgaattttcaacagctacagatacacttgcacctcccacatccacacggtccccttcctgattgcccgcagatggtgcggatgcggcaaaacttgcagttcccgccgcatctgctttaaatttaacagttccgcttgcacgtttgtttccggaaccgtaacttcccagagtcatagaaaccgtgcctgcatttacactggtttccgctgttgctgactgataagtaaaaagatctttggaatatgtcagatttaccgttcccgtcacccctgccggaagtgtcactgtcactgccagagtatctcctattttcacggatctggcgcttaaagcaatgatcatgctctccgcctgtgcatgcacatccggtgtcatgatacaactgatcagaaataccagtgccagtaccactcccagtatccgttttccttttgctttgcttttttgtctcatatgttctgcctttcttttactgctgaatggtgatcttcccctgaagatgtttgttcagatataccagatcaagcacattgaccccgtcttttttgcggtttgtatctgcggccttaagataacatccggtaagcttttgggtaccattcagatgcctgttcaaacggttcagatctgttttgttgatctttccatctccgtttacatctccataaatcacaagcgtataggaagaaactttcttatttttgctgtcatacacctgcagaacattgccggttgaaacgattccggtaacactctttttggatgcactgaacagtttgaccgttcccgcggtcactttaagttttttcaaaaatgttgccgcctttgttcccggcgcaatccccgtaaccattttgtttttcaactgatatgttttcgaagtcacggaagtcttctcggtctctgccgctgcaccagctttctttacaatggtaagcgtataggttttggatgctccgctctccgatttgcagataactttacacgtattggttcccgtctgaagttttttggtgccggttcccgtcacagaagatttcgcagctaccggtgatgcacttatggtaacggtggaaactttgctgtccacgacgagggaatacgaagtcgtgtctccgcgaaataccggtgtcagtgtctgtccggttacgctgagcgatttcagatagttattcggatttccactggctgtaaatgtcactgcagatgccggcataccggaataaaccggaatacggaatacaaatgcctgctgcttgtccgcatacccctgtccaagctttctgccctcgttgtaagcagccgcaaggtttgccatatactggtggctgtacagattcttctgattcactacattaaacttctggaaatacaacgtatcctggcccacgccaatatagtttttcgccagaattttcgctcctccttcgagcgctgcataacgggtattccatcccgctttttttgcatatgccagtccgtttttgatgaccagtgtggaggtaatgcccgctgcccccacattaaaatagttatagtaaccctcataaccgctataagttccggaaatcagggaactggttccttttaacccctgctcctgacgcactctcgatgcaagatgatacgggctgaccccggtttcctcaccgatatccataaatgcctgcgcataatccagctcagatccgtcgctgtcctcaaccatattctccataaaggttcctttcaggatagaagaaactccctgtctggtctgcaccttgctgaaacttaaactttcaaattgaaaaatatcggtttcattgagaaaattccgtggatctaaataataagcgatatagtctgcatcagcaccgacccacgaagatccgtcatagaccgtccacacattggtggtccagtcatatgcaccgtctgcggtggatttggttgcgtcatttccagtcttcggaacaagattgactccgtttacgctctctttgctgaccacggtattccaatcaagcccggtcttaaccgcctgaaactgccactgcggatatgctgtgtgaagcacggaaagtgcactgatgtaactatccggaaatcctgccgcacgcagctgcacggcataactactggctgctgcatctgtacgcacactgactccggcaagtgttcctgttataagaattgccccacaaagcagggcactcaaaaagcgttttatctttcgcatattcttcctcacctgttatgatctgactgcgcggcatcccaaatgcagtgcagtctttctgtatcattatatagaaaaagcatatctgcgtcaattctgtgcgttgttctttttgttccgggtacagttactctcctttatgatataatgcggacgtcttttgacttccatataggtttttgcaatatactgtcccataattcccatacaaaacagctggattccgccaatgcatgtcacgatacataccagcgacggccagccggcaaccggatccccgaataccaatgcgcgtacgatttccgcgatgattgcaataaaagaaaccacggtgagcaccagccccagatacgaggaaatcttcagcggaacatccgaaaaattgataatcccatcaaacgaatagcgcacaagtttccagaaactccacttggtttctcccgcagaccgttctacattttgaaattccagccatttggtatcatatccgacccaggcaaagattcccttggaaaaccggttgtattcgctgacggaaagaatggaatctaccattgcacggttcatcagacggtaatcccttgccccatctgcaatctcaatgtgggaaagtttccgcataactttataaaacatgcgtgcaaaaaacgaacggatcttcggctctccctgccggttcacccgccgggttgccacattgtcacagtctccggcttctaacatcgcagccatctgtggcaaaagagtgggcggatcctgcagatccgcatccatcgtcgtcacataatccccctttgcataggacaatcctgccagcagcgccgcttcttttccaaaattgcgggaaaaagaaagatagtgcacgcgctcatcttctgctgcaagttcccggatcttttgcagtgttgcatccttcgatccgtcattgacaaataaatattcaaaatcataatcgcccatttcccgtgtcacgcggtttaattcccggtacaaaatctgcagagattcctgctcattgtacatcggtacgacgatgctgatgcattttttccccatatttcccccttatcttatatcttatccacatactaaacaggaataacagaagcgcagctatgctgatggcagctccgatctgtacgcccggtgtggtataacgcagctcgatcttatgcgttccttcttttaagtgtacaccaatgagtgcatccgcgaaaggctttattttcgtctttttaccgtctacatacagactccagccctcatctgccggcactgacagaatcagtcttcccgcctgcctgacatcgatacttccaacgatcctgcgatctgtcattttttcgagtgacatggtctgttcactgagcgtctcatacgcggtgcacatgaccttgaaattcaggcggtacacatggtattcgatcgtttctgcattgagattggtaatatggacctttgttccggctttgcactctcccagatccagcagatagcggtgggtggtctttccatactgctgcgtccatccgtcatctcttgatactgtcagggaatccgcattgcaggtcacataatccgcataataatatccatcctcggaaatatcaattgtcgtatccccggctgcctgcgactgtgtacaggttgccggataaagcatgtctccttttgctcccagctgctgtgccagggaattcagggaaccgatcctatcaagcatggaagattcccagccttttattgccttctcgctcatcatatagccaagtggcaggcagtagttattccgataaagataatttccattgctgcttcccacaagtgtccgcagtggactttcatccaccggattagaggaaagcatatacttcaccgaaaacatggctgacggaagcggggaagcaccattgtaacagtagaaattttttccgccctccatatacaggctctggaagagatggctgacatccagattcatcagggaggaaaatatggttgccgaacggtatccgtacaggctgtcatcgtttttggttttccgcccactgtcctccacccggtaaaatccgtcatttccgttatcctcttttgcctgttgcagcagatcttcgtagtacccctgtttatccgtatatgccacgcggctggtaacgccaagcccggttaccgccatattgactgccagttctgcaatggcaacacaaaaggcagcttcccgcagggctatccgcattttcttcggggcaattttaagcaaaagaagcaggattccataaactaagataaacagcatggtaatcacaactgccatgtactctgtcaccagttcatccccgtaatatccggagagaaccatcagtgtcagtgctgcaagcactgctatgatgatatgccagcatctggttcctttccatttgcggatcgttgcaaatcccatgaccagaagcacaaaaatgtaaaggaatgactgtctgcccggcaacgcctgcggaaaatgcataccatgccagatataatccagctgattatccgcaaagctcacaaggaaaaagacaagcatcagcatacgcggaactttttccttccaggagattctgcggttcagcacatacagccataccagtaccagggtaaatgccccggcatacagattcggccagtgatcatttcccgtataacttgtagtgacggctgccgcacgccccagctccgcaataacagaaaaataccactccagcgttttcggaaagctgtcttcagcagacccggaagcagaaagcacggcgatctccggcaatagcagtaccatcgagacagaccctgccagcagggaataccatgcaaaccgtaaaaatgctttcagttttcctcctttctgcgtaaaaaagagaagaataaaataaaacaccagaaagatacagatcatgatggaaatgtaataatttgcaaacaccgacaatgcaagtgtcacaaaatacagtcccggtttctgctcccgtaccagtttttccagtcccaccatgatcagaggaaaaagaaggatgcagtccatccacatgatatcccagctgtaggctgccacaaatccggacaatgcatatgccgtagaaaatacaagtgccggaatcacctgatttttatggagttttgagtcttttccaatcagatgaaaatgatattttaagaataagaaaaaagtcagtccgcacagggcaatctttgccagcaccagtatcgtcataaactcgatcacataatgtttcgggcagagcacgatcagaaaattaagcggactcgccagataataggcatacagggaaacaaaatccgatcccagtcccaggttccaggaatactgcagacttccgccggttcttaatttatgaagaaactctgtaaaaaacggacagtactgatgatacatatcgatatgcagaatacagttatccccgaaaggatataccccgtttccgatacagatgaccacacagattataaatggcataagaaatgccatcacataaggaaatgaccggtgcgacaccatccgcgaaatcatttttttcatgttcttactcatccttttccttgtttttttcaaacaactgataatactgaagcttcttgtaagtctgaagctgtttttcatcggctccgatcccttttgtctgccctgctgcagagatcaccgggtaagttttgctcagacttaagaggtaattctggtatgcattcgtcggcactcctgctgcggtaagtacctgcgccgcaagataattcagactcgtatttttatctttcgctccctcgatcccataattactccacaccagataaggtacgagataacgtttttgtgtctctgcctgtgccccgttttccacgacagaagccactgtatcattcggctgatgatccccgaaaaatacgatgatcgtcctgtcatccactttggaaaaataatcaatcagattttcgagtgcctgatcggtcttgtggatcagtgtcaggtactgattgagcggttcgctggcatactgtgactggatatcattcgtcagattcatataggtatcggtatatccgccatgattctgcatcgtcacattgaaaataaaggccggtttgccggaggctttgtttttctcataagtttctataatatgctccatatccgatgcatcgctgatataattgcgcacataggagacatccctgtaatcttccataaaatccagattgtcaaatccaagcagaggatacactttatcccggttccatccgctggcctgatacggatgctgtgcataggtcgcatatcctaaggatttcagataacctgctaaagacggtgtcctgctcttgatgtactgctgatacggaatacttccgttcggaaggaatgccatcgtattgcctgtcagaaattcaaattccgaatccgcagtgtttcccccacacacagatgtctggacatatcccgtgaccgtgtttttctccccctgctgcatccggtgcataaacggcatgtaatcctcattggtttctaacggtcccagcacttttaaatccgaaaatgcctcatccatgatgacaatgatgttgggcagatcctgtgtgtcggtttctgttgttttagtttcgtatttcgccagcgtctcttttgcttcatccgcatcgtatcctgccggacgttccactgccacataggcaagatccatggcaaaggtcaccgccatgccgtttacttttgtcatatatgccggtgtgaacagaaacggatacagataatgttttgtctgaaacgattcctgctgcagggcattgacaaatgtacacaatgccagtcccaccagtacgatactccccagccttattttccaggaaaaacgcggaccttttttaaaaaggcgggtcagcacaaataatgcaataaaaacaagtgtaacaatcaccatgcgccggtccggtgtaaaatcatagtttccagccacactggctgctgttccggccgaaaacagatcccacggaacaaacggtgtggaacggaatttcatcacataatgattggtaattccaaacgccacagcaagtccgtacagcactctggacgcaaaacacattcttccggtcagaaaatataacatccatccgatcagctcaaacaaaaaaatattaaaaagctgtgcttccacacgcacttccgcaaatggattgtgttcataacattccatcaggtaaaaagcaaacaccggaaccacggcataccaaaacagccatatgcccttctgtttccacccttctgtccgtttttgtgtgttgtttttctccctttttgtctgcttacgtgcgactgtctgctccatgtttcctaacataaaaatgagtatggctccttccattccttccatttccatcgcttttcatacgattttatctgaatagaattttaccacactcattctgcttttaaaacgcatttcacatttttatcataatttcattctagtaattggataacaccagatgctcccggtatgcacgatccataccatcgatcacgcggcgtgcctgcccgtatctgcgtggattgatggtgatcacccagagggtatctgccccctggtagatttccctcttgaaaaaaggaatctttttactgttctttgtaaatggaatgtgctgttcaagcagtgcctccgccgtatgtgtactcactctggaattggtggtacggcacagttccacgtcgttatccttataatttccaagtttcatcgtcatgctttttgcatcttcctcctcacgtgacttttacctcaatctccctgccaagtcctcctgcaactttttccagaaagtccagactcggattatatctcccgctctccagacgggaaatatttgactttctggtaccgactttttctgcgagccgttcctgtgtcatcccctgctcctttcgcacctgccgaagctgggctgcaatttcctgtctggcgtgattatgttcctgcatatccgcccccttacacctttataaatcgtgctcatgtattctaaagttatcatatatgataacttctgtcaatgaaccaaaagtcctattcccgaaatcataaaaaggcttgcaaatgcgtctttcatatgttaatataatatttgttcgcgccggcatgtcggaattggcagacgaggcagactcaaaatctgttgatggcaacatcgtgtgggttcaagtcccactgccggcatataaaagacctcaggtttccaatcggaaatctgaggtctttctttttgcggcacatcgttttcttaaaccaacagaggacgcatcccgttcccccgggattgcgtcctccattattttacctgtacatcctaactcctttattttgtaatcctgatatcatcaaaacagtcaaatgttgcaaagtaatcttccggtgtctctgcacggcggatcatcttcacgcttccgtcttctttgagcagtaattctgcagaacgaagacgtccattgtaattatatcccatggaaaatccatgtgctccggtatcgtggatcacaagataatctcccatgtcgatctctggcagtttccggtcaaccgcgaacttatcgcagttctcgcaaagacttcctgtcacatcatacacgtgatcgcatggtgcattttcttttccaagaaccgtaatgtgatgatatgccccgtaaattgccggacgcatcaggtttgctgcacatgcatccacaccaatatactctttgtagatatgtttctcatggatggccttcgtcacaaggcatccgtaaggtccgagcatgaaacgtcccatctcggtataaatggatacatccccaagtcctgccggaactaagatctcatcgaactttttgtgcacaccttctccgatgacagcgatatcattcggctccttgtccggtgtataagggattcccacaccaccggaaagatttacgaatctgatatcacatccggtcttttcctttaattccacgatcagttcaaacagttctcctgcaagcttcggatagtattcgtttgtgacggtattgctggcaagaaatgcatggacaccgaaatgctttgctcccttatcctttaaaatcttaaacgcttcgatgagctgatcctttgtcatgccgtatttggaatctccagggttgtccatgattccattgctcagttcaaatactccacccggattgtaacggcagctgatggtctccggaatatgaccgatcgtttcttctaagaaatcaatatgggtgaaatcatccagattgatgattgccccgagttcatccgcataggcaaattcctctgccggcgtatcatttgaagaaaacataatatgctttccgtcaaatccacaggactttgcaagcatcagttctgtgtaagaggaacagtcacatcccatatcatattcctgtaaaatttttaaaatatatgggtttggggttgctttcactgcaaaatactcgcggaatcccggattccatgcaaaagcttcctttactttttttgcattctcacgaatgcctttttcatcatataaatgaaacggtgtcgggtatgttttaacgatctcctccacctgactctttgttacaaacggctttttctccataatctggctcctttatctacactttttcgtctgatgttatgctacaacaactcttttacaaattcaagcaattttcgccttttccttttatttttccacagattatgatatgatatgcatgatcgaatgttagattaagcgaacgaaagatgaggaacatcatgggtgtaacagttttaccttatattgatcagacacagacagccaggctgcaggaagcagcttctgccaatatacagacaccgaaaaatacggatgaagccgtcaccacatttaaggaatgtctggcttccgctgagcgcagcgtacaggccatggcagtggacgcactgcttgccgccagcaacagtggtgccgtttccctggatacggtacagcagatccttggatttaccccgcagaccgatgcaccggttgatacgtctccggtcacggataccccggcaatttccagttcttctgcaacaaatagtaccacctcctccggcagtgtttcttctccggagaacctcgaagaatatttcaaagaagcttctgaaacatacggtgtggatatcaacctgctcaaagccattgccaggcaggaatccaatttcaatccatccgcaaccagctctgccggtgccatgggtgtcatgcagctgatgccgtccaccgcaaaaggacttggtgtcacaaatgcatacgatgcacagcaaaatattatgggtggtgccaaactgatggcgcagaacttaaagaaatacaacggagatgtttcccttgcgcttgccgcatacaatgccggtggtggaaatgtcgacaagtacggtgggattccaccgtttaaggaaacacagaattatgtcaaaaaagtgcttggttattatcagaattccaacgcttaatttctaaaaagaacccgtgaagatgaacggtctgctgttcatcttcacgggttttttactgtctaaagaaaatttgattataatttgaatctggaaagaagatctccaagacttgttccggccgtttcatttgagctgtactcgattgcctctgcctcttcttcctcctgcggcttttccataatatcttccagcgctttcatgctcaggctgacttttccatcgttggtatttaaaatcttcgcctttactttctgtccctcttttaaaacttcatgaacggaagagatccgcttctggctgatctgtgaaatatgaaccagaccgctgatgccattcccgatattgatgaatgctccgtatggcataatggattctacggttccctctaccacagatccaggcacaagcatggcaatccggtgatttctttcttcctcgcgctcctgtcttgccacaacttttccggacaataccagtttattcttctcaggatctacggtaatcacaacgacacgcacatcttttccgatccatgcatccgtgtcttccacataatctgcggacaactgggatgccggaatgaatgcacggattccttctaagaatgcaaccacaccactcggcacactctctttgatccggacagtcacaactgtctgctgctccatcatctcccggagtttatcccaggcaagcacttcgtttgcttcctttttcgacaattcgatgtttccgtgtccgtcatctgtacgcacaaccgttgcctcgatgatgtctcccggctgtaattcttccttcgcatgaaaatccggatcattgctcaaattttcaattttgataattcccggtgcataataattcaggtcaagtgtcacttcttcatcggttactgctaccacagctccactgacaatatctccttcgttaatcgtgcggaaagaacgttccagctccttttcataatccttcattgattccatctgcaaaacctcctttaaaatatctgaaaaattgcaaaacggcagaaccccaaaggattccaccgttttatgaagcgagctgatgacgggaattgaacccgtgaccccttccttaccaaggaagtgctctacctctgagccacatcagcatctcgttgaccgcgtcaactcctacatcatacatggtattttctaaattgtcaagaattttttaattattttatcaaattacagtttccagcgtgttgccgttttcccctgatgtgatccgcaatgattacagcctggaaaacatgcccctatgggtcagggctgtaatcatgcagtcatttgcaccgcagtgcaaagcctgacagtataacgcgtggttatcagacaatttttaaatttcaattacatatctctcatatgcattgatcactttggtatctccgatgaaatcctcccgcggaatatcccttccataattcatatgcatatgtccatgtacaaaatatttcggatggtatttgttaatcacacgataaaatgcatcaaaccctttatggcagagatcttccccatcatgcataccgcctgccggggcatgtgtcaccaaaatatcaatgcccctttttcggtgtattttccagaaaagtctccggatgcggcgttccatctgcacttccgtatactggttcacccctggtttataacggtaagatcctcccagtccgagaatccttatcccatgaaacatatacacggtatcttcaatacagatacatccctccggtggctttctttcgtacttatcatcatggtttccatgcacatacaataccggaactgcaatcatcgttgcgataaatgacagataatctgctttcaggtcaccacaggaaattaccagatcaatatccgcatagtcttcttttcgaaagaaatcccagattttctgagattcttcatctgctattactagtatcttcattattttattttttcctctacaccttttatctggacaaccggacgtgcctctgcacgtaattctcccattgtcggtatctccccaatgacattatctgtcaaccagtccatctccatgatggcttccggtttcatggctttatccttcttgtttttgagtgtcccgtcctgtgcacggatttctccgtaaaacggcacaatatctccctttttaatatcactctttaagtgatccaccagacgcttgaccccggtcggtacattcttcgaacagatcaggtcaatcacacccgcagacattccccaccagtagttgagtgccctgccctcagaattttcttccgactggtaagatcccgcaagaatactctggatcattttttcatagaatacaccccagttccagagtggcatcaccagattcagtttccttccatcctccgaacactcatacagcccaaactgcctgcccggatcgcgcggtgtaatcatatcctgatccgataccacctgaatattgttgtcctttaagaaccgttccctgtcataattttcactggtggaccatgcaagataaatccttgcccgtggattggtaaaacttgctcccagcgcaaaggcattaatatttgcgatcattccgtatatcgggtaatctgcaatatatgcaatcctgtcattttctgccagtgcacccgcaatcattcccgaaaggaattttgcttcatacatccgggcatagtacgtgcggatatacttatgcgaagtattcagactgcagtttaaaatctttacatccggatgatccacagccactttcagactgtctttcatcatctgcggtgccacctcaaatatgatatctgccccctgacggatcacgtcattcagcacctgctccgtgcgttcctccgtcacatcattgacacagatggtcttcatctgatccgggaacgtctcttccagataattgcgcccaaggtcatgcgcataaatccagtcggatgtatccggtgattttggatacaggaatgccacggtaaatttctttgctgacgatggcataaagtaactgaagatgtttcttcccttacgctcttctgccgccagcggatccatgaccagaccaacactctgtttctctgtgagcatgacaaactcattccagcatttcacaatatttaaactcagctcatcatccgacatgccaagaaccgtattgtaaccgtatacattgataaatgcagtcagcgcatcccccacccggatcggaagcttgcgccctccgcggaactcatatgcctttgtgaaatgattgaccagactgttaaattccattcgggtatccgcatcccatatggcagtggatcccatcagtgcaagcagtttatccaccataccgattttggaaaattcgatattgttcaatcccgaaatctgattaaacttcatatattcataatataattttacgtcctcatcctcggaatactttggaatcttacgtgtcacgttggcgacaatggaatctgccttaaaatacttcagtacactgacacgcttgtttccctccaccacataataacggttcatatattcataagcaacaatcggatcccggataccttcgtttacctgtgcatcggacagcgcaatccatttgcatgcaaactctgtatccgcatcgaggatcggcataaaattggctgcaaaagaatacgttctccctttcgtcgccgtaccaaccacaaaatccaatggtatctgcatcagccccatattctgttccgtctggatattttctctggataaaatatcatccagaaccggcagatagggaaagcgcccctgcgaaacgcatgccttatattctttttttccaagtttgagtgcttcctgatattcgttatctcccattttttctcctttctacggttattccatgtttttgttattccaattttaccacatctgtgttatgataccaatgaaaagtgaaaaaaagcaaagattttctttctttatgtgctaaaatttgctataatcaaatgtagtaataggtactatggaggaaattctatggagaatatcacgaaagaacaggctgatatcatcggtgaagttgcaaatatctgtacaggtactgcggctaccgccctcagtatgatcatcaaccgttcaacaaacattaccactccgcttgtagaagtactggacaaagaaaacacgctggaaagtgacaaccatattctggtcaaggttccatacacaagcggcttagacgggacaaatcttatggtactggatgttcaggatgcgctggtcattgcaagtcttatgatgggcggtgacggtcgtaatctttccaatctgcagctcgatgatctcacgttatcagcaattgcagaagccatgaaccagatgtgtggatccattgccacatctatggcgtcactgttatccaggccgacagatattggatttccgcttatcaattcaaaggatcgcaagactttcgagattccggatgaactatgtaatggaacagatatcgtcaaggtcacttttcgcctgaccgtggaagacctgatcgatagcgagctgatacagttataccctatcagcatagtaaaacagattttaaaacaggaggatatataaatggcaaagatattaatcgttgatgatgcagcattcatgcgaatgatgctcaaggacattctgacaaagggcggatttgagatcgctggtgaagcagcagacggtgtagaggccgttgcaaagtataacgagttgaaaccagatctggttactcttgacatcacgatgccaaacaaagacggtattcaggcactcaaggagatcaaagcagctgatccaaacgctacatgcgttatgtgttctgcaatgggacagcagtccatggttattgaggcaatccagtccggtgcaaaggatttcattgttaagccgtttcaggcagaccgtgtattagagtccatccgaaaagtattaggataaatcttatcgtattaaaaaaggagcaccgtatatggatgctccttttctatttcttgtttttacaatcgtctattcttattttctgacaaaatacagttcttttacaattgccggagttgctgcagggcatcatttttcaaaatacagatgccgtgttcctgtatgaacgctttccgctccgctccgacaagaatatcctgtgcatattcatccgtcagattcgagagtctccttaaactgccctcttccataccggaaaatgtaaggatcagcatatagcgatcctcgtatttataaagctgacccgtaggcagatccggtggcataatgttttttgcataacggagcagcctatcaaaatccgcaaacactatcgtggcataaacaggaacctgatccggattttcctcgttttgccgtgcttcattaatctgtgcccacttctgctgtggaattgcattcatcagtccattgacaatatctttcagatgctccatcatttcatccgatcccggatgctccgaaaacgtaagtgccagcgtatggtctgacataaaatcagcacgcactgtcttgatgcccagttcaaattttgtctcaaaactctgttctgccatatcaaaaatctggttcataaattcctgcgtccgctctccattgctcataatttcctcaatggtgtatcccagatcctgaatttcctgttctgatattacacaacgaatggtatgttttccaatttttgaaaacttcatacgctcaccctctttcctccagatgattcatctgcctgatcttttgacgtattctctgtaatgcattgtcgacagatttcgggcttttcttcatcagccctgcgatctgcatatagttatttccgtccagataaaattgcaacacctgtttttccatcggacttaaccggctgttcacccggttccacaaatccctggacacttcctgttcgatcaccagctgctccgggctgctggtaaacccaatactgccttctgccccctgctcaaaaaaagataaataggaattcaaaggctgatgcttttttctgttggatgcctctattgcagaatacagctgacggtgaatacacaaccctgcaaaatgaaaaaaactgctgtctttgtccagacaaaaatcccggatggccttaaacaatccaatcatgccttcctgaatcagatcatcggtttctcctccgatcagatacatggcattggcatatttgcggacaagcggcttatatttttcgagaatatagtccgtgatctctgtttccccctgccggagtctttcaatcaattcctcatccgtacaagcatcatacttcattcttttcttatcccttcttcatcctctgacgcacaatctcatacgagagaactcctgcagccaccgatgcatttaaggaatcaatatctcccttcattggaatggaagccaccatatcacagtttttctttacgagtggactgactccatctccctcatttccgatcaccagaccgatcggtccggtcagatccatatcgtacattaaggttccatccatatccgcacacacaaaccacataccgcggtctttgagttctttcatggtattggagatatttgtcacttttgctaccggtacataattaaccgcacctgccgatgtacgtgcgacggtcggtgtcagtcctacggcacggcgttttggaatgattacaccatgtgcccctgcctgattggcggtacggataattgcccccagattatgtggatcttcgattccgtctaaaatcaggataaacggtggttctccctttttttctgcaagtgccagaatatcttccaccctggcataatcatatgctgcactgacagcaatcacaccctggtgctttcctgtctcagaaatctgatcgaggcgttcttttgtcacataattgacgattgtatcgtgctttcttgcctctctggtaatggatctgaccggtccatcctgacagccgtccagaacatataatttatcgattgtcctgccagaacgaaatgcctcaaggacagcgttgcgtccttcaatatgattttctttcattccggtaaatgttttcttttcgtcttccataattttttaccttataaacgcagatgcaaaccatctgctgcttccttaatcaatgaaaccagccggtcgaaccggtccgtcagatacagatatcccaccagtgcctccagccccgttgccttacggtaatccgccatcgttgcattttttgccatggttgccgacttggcattgcgtcctctgcgatagatgtccgcttcttcctccgtaagcatcggttcaagatattgtatgataactgcctgcgtatgtgcttttacaatctgactcgtccggtgatgcagctggttgggacgggtatttcccttgcccacaacaaccgaccggatcaccagatcaaaaacaccatccccgatataagccagtgtcagtggggaataggtccggatatcgacatccggaacctcaaattttttcttgatgtatgcgtcaattccttcactcatgcattgcgctcccatacgacaccttcgcgggtatctttgatggtgatgccccgtgcaagaagctcgtcgcggattgcatctgcacgggcaaaatctttcgctttctttgccccggcacgctccgcaatcttttcattgatgaactgttccagttctgcatccacgctcgttcccgcgtccagtctctcctgacctgcagttgtcagattcagtgccagcacctggtcaaaatcattcagcagtgccagctttgtcttttcactgatatctgcctttaccacgtcatagacgatggtcagtgccatggaagtattcagatcatcacggattgcatctgcaaactttttacggaatgcttcaaatgcttcctgctccatctccccctcatctttgaaggtggcaatcttttttactaatttttcatatgcactctctacgttgtccagattgtcataagaaaatacgagtggcttacgataatgagactgcagacagaacatacggtatgccagaggatcgtaccctttgctctccaatagagataccgtcaggaaatcgcccttggacttactcatttttccggtctggtcattcaggtggtttacatggaaccagtacgggcaccatttgtgtcccagatagctttcggactgtgcaatctcgtttgtatggtgtggaaaaatattatctactccgccacagtgaatatccatatactcacccagatgtttgattccgatgcaggagcactcaatatgccatcccggatatccaacaccccatgggctgtcccacttcaatgcctgatcctcgaatttggattttgtaaaccagagaacaaaatcgtttttattccgtttattttcatcttcctccacatcgtcacgcacgccgacctgcaactgttccttttcgactgcggaagaaaatacaaaataatcctccagtctgctggtatcaaaataaacatttccaccggcctgataagcatatccctttttaagaagtacctcgatcatgtgaataaattccggaatgcaatgggttgcaggttctaccacatccgcttttttgatatttaatttccggcaatcctcaaaaaatgcatctgcataaaattttgccacttccataacggtcttgtgctcacgcttagcaccttttaacattttgtcttcccccgtatccgcatcggaagaaaggtgtcccacgtccgtgatattcatgacgcgctttacatcataccccacataggaaagtccacgcacaagaatatcctccatgatataggtacgcagattcccgatatgcgcaaaatgataaacggtcggtccacaggtatacattttgattttgccatcttcgtgcggtatcactgtctcaatctttcttgtcagtgtattgtaaaagcgaaattgattctccattgtgtctgtccttccatctgtttcttcttatatattttaagtgtacaatattttccggcaaaagtcacgtcttatctatgatctgctgcacccgggacatcctgcacatttactcccgcccccgacaaccatactgctctcataaaatccgttcagcatacagattgcctgtgacgaaattccttcttctgttccggtaaacccaagtccttcctcggtcgttgccttgatattgatctgctcttttgcaatgccaaggatctttgcaatattctcctccatctgcgcaatatacggacgcagctttggcttctgtgcaatcactgtcgcatcaatattttctaccacataaccattcttttccagtaaaagacgcacatgttcgagcagtttcatgctggaaattcccttatactgcggatcggtatccggaaaatgttttccgatatccccgagtgctgcagcaccaagcagtgcatccatgattgcatgcacaagcacatccgcatccgaatgtccgagcagtcccagtgtatgcggaatctccacacctccgagaatcagtggccgtccctccaccagtttgtgtacatcataacccattcctacacgcatttttcttctcctgtctttttatgatgttgctgattccagttccccctgcaaacagcttccttataaattctaatgataacatgccaccaggcaaagcctgatgaccttcacaggcttcaagcctgttttattataacacaaattcgggggctgtatcaaacagtccccgaacgaagtatcacatcagttttcaactatgcaagtgctgctgtaatgattgccatggaatatacttctgatgcattacatccacgggacagatcattgattggcgcattcaggcctaacaaaatcggaccgtaagcttcgaaattaccaagtctctgtgcaatcttgtatccgatatttccggcattgatatccgggaaaataaaggtatttgcatgtccggcaactgaagaatccgggcactttgttcttgcaactcttggtgataccgctgcatcaaactgtaattctccctcgattggaagatccgggtatttctcatgtgccttatgtgctgcattgcgcatcttatctacatcctcgccctttccggaaccaagtgtagagtagcttaaaaatgcaaccttcggatctacaccgaaaattcttgcacaggcagctgactcaccggcgatctctacgagttcatcctcggtcggatggatgttgatcgcacagtcagacattgcaagaacctcgttctcacctgtcgcagacggacgaaccagaataaagcaggaagatacgatgctgttgccaggttttgtcttaatcagctgaagtgccggacgaacggtatctgccgtagagtatgtagctccgccaagcagtgcatccgcaatgcccatctttacaagcatggtaccaaagtagtttgcctgggaaagaatgcctcttgcctgctccggtgttactcccttgctctttcttaattcacagaacagatctaccatctcatccatacggtcaaatttctttggatcaacgatctctgccccacggatattaaatccgctctcctctgctgccttttcaatttcatccggatcgcctacaaggattggatgtaaaaagttgcttgcaagcagacgggaagatgcctcaagaatacgaggatcgcttccttctgtgaatacaattttctttgggcttttctttaatacttcaatcagttgtccaaaaccaaacataataaatctcctttatctatacttaattttattattagctaccactaattgtatactcgttattcacgaaattcaatgcatttacgtgttctaaaatgagaacattttgcataaaaagagaccccatgctgattctccatggggtctcctgtaaaatgaaggatttatcacaaatgacgtttttactgtattttctactgaattgccttaaatgcctcatccagatcctcaatgatatcatcgatattttctgtaccgatagaaagacggatcgtgtttggcttgattccctgatctaaaagttctgcctcattgcactcggaatgtgtggtgcttgccggatgaatggcaagggacttcacatctgctacgtttgcaagcagtgagaacagctcaaggttatcgatgaattcctgtgctttttctgcaccacccttgatctcaaatgtaaagatagaaccgccaccattcgggaaatacttcttgtagagtgcctgctgctccgggtctttggaaatggatggatggtttactttttctacctgtggctggttctctaagtatttaacaacctttaatgcattctccacatgacgctctacgcgaagggaaagcgtctctaatccctgcaggaagataaatgcgtgtaccggagaaatggtagcacctgtgtcacgcagtaaaattgcacggatataagtagcaaatgctgccggtgcgcagtcctttgcaaagcttaccccatggtaagatacgtttggctctaccagccatggccacttgctgctctgtgtccagtcaaattttccgctgtcgatgatcacaccaccaatggtagttccgtgtccaccgatgaactttgtagcagaatgtaacacaatatctgcgccgtgctcaatcgggcggaccagatacggagtcgcgaatgtattgtcaacaatcagcggaattccatgcttgtgtgcaattcctgcgatcttttcaatatcaactacttcagagtttggatttccaagtgtctctatctcaatggctttggtgttatccttaattgcagcttcaatctcttcatagttgaacggatctacaaatgttgcctcaatgccataatccggaagcgtatgtgccagaagattgtaggtaccaccgtagatattctttgcagctacaatgtgatcccctgcatgcgcaacagcctgaaatgcataagttaatgcggctgctcccgaacctaccgcaagtgccgcaacaccgccttcaagtgctgcaattctctgctcgaagatatcctctgtcggattggtcagacgtccgtaaatatttccggcatcctttaatccgaaacggtcagcagcatgctggcagttgtggaatacataagaagaagtcagataaatcggaacggctcttgcatcggtaaccgggtctgcctgctcctgtcctacgtgtaactgtaatgtttcaaattttaaatttctgtctgcgtaatgttttttgctcattttaatactctcctttttctgctatttttgaaatcacatttacctgatccggtaaagtgtggggttttcgtttgaactggttatatcataccacagaggtaggaaaagtgttagtcttttatttttatagctggttataagttttgcttatagccgatacttctacagtactttttgtcattttatcaaaaattcagaagctggagaatgcgctcactcccctgttcatcccggttatcaatgacaaaatcgcagatctcccgattccgtttctccgcatccagcgacaacagacgaagggttttctccccgacagggaaatccgactgcacaatatctgcaatcatgtcttctttatcttttgccacatagataattgcggtcggaaaatgccgcttcatggcaattgcgccacacatatccagggacatgacggcatacttgccatcgtcaagcaccgcctggatatcttccttttttgttccgtaatgcaccccggcgtacatggtgcgttcaaagaaatcctgctgtgcaaactgttcttttgtcagataatgatgcttgctgcttttcttggtgcaataggttttcggattgacaaagcggtgatcctgacataatgttttggtcaatgcgtcttttccggaaccggacggtcctaccagtgccagaaccgatggattttttatttccatcgtgcgcgtctgcgaggcatggatgatctgcctgaccagagaaacaaattcactcatctgattcacggacaggagtcctgtcatcttccagttccacggcttacgcatcagcaccggatacgtggccggtgtctcaagcacattatgaatggcatcatccaggatgatatcaaactgcaccagattcttggcattgcccagaataatattctccggcgggaattccggaaatgctgtaagaatctgttttgcacggattcccataaatgccggtgctaccgcagtgataaaataaacatccgcaatttccatcaggcggtacacagcttttttgtttttctccggaacctgctggcgtgcatagagttcttcgtcctcgtaaaattccctgataatacctgtacgtccacggttttcccaggtatcaatctcctcaagccgaagcggcggatcgatatgatatttttcatttgccatggcaattgcgatactgttaaacggtgctgttacatcatcccagtccagtccgatcttcggtcttaacatccacccgtgcccccttctttgtttctaaatctgccgatttactcctcgacagaaaccagttcaatggtagtgctttttgtattttccatatcaattctcctgttcaggtttttataatataacaaaaagcttgtgatccatgaccacaagcctgtatagtagcgagggagagactcgaactctcaacctcccgggtatgaaccggacgctctagccagttgagccacctcgccatatttagttccatcagtttttctgatgaatgggacctacagggctcgaacctgtgaccctctgcttgtaaggcagatgctctcccagctgagctaagatcccatttcgtgttggctgctctcgcaaccgacttcgttagtatatcgtacgagaacagatatgtcaacactttttttgaatttttgtattttttgtatttgttgtaactattccaaacaaatttccatgcaggattgtcccacacatgctatgcaagcagccgctctaccaggcgcacacactccgcggcatcctttgaatacccatcggctccgatctcatctgcaaaactctgtgtgatgcaggctcctccaatgatcaccttgctcttgcagcctttctccttacaaagctccacaacatcctgcatacgcatcatcgtggtagtcatcagcgcggacagcccgataatcgcagcattttcacgaatcgcggtatccacgatatcttcacacggcacatcttttcccatatcaatcacgttgtagccataatttttcagcatcagtacgacaagattttttccgatatcatggatatccccctctaccgttgcaatgacaagcgtcggcatctcctgtccgtcgttcttcttctccagcatcggctcgagataatcaatggcaagtttcatggtatttgcactggcaatcagctgcggcaggaaatattttttctgttcaaaaaattccccgactttattgatggctgcaatcagctggtcattgatgatctcctccggctttgcgccgtctgcaattgcctttttcacttcatctataatggttcctttatttccttttaaaaccgctgtcgtaacaggatctgctttttcttccacagatgccgtgccacccgcagcaccttcttttttcacaacaaccgtctcatattttgccttttcctctgccagtttattcatacgctcgatgtagcggatgtcactgtccgggcgatgcagcagcatgtccgaagcaaatgcggcattcatcaaaagttcctgcgacggattggcaatcgccatggtaagcccccggcagatggccatggtaagaaatgccgtattgacaaaactccgctccggcaggccaaacgaaatattcgacagaccacagatcgttggaagcttcctgatatccttacaataagagatggtatcataacattctttcgcggcctctggattggctccgattgtggcaaccagtccatccacgacaatatcctcgtgtgccattcccagctccatggcacggtcatatacggtatcgataatctcatgcttttctttggcatcctttggcagtccctcatcggaaagcggaagcaggacaaacatagccccgtacttttttgccagaggaagcatatgctcgattttttctgtctcaagggaaacggagttgatcagtgctcttcccggatagacacgcagtgcctcttccataacatcaatatggctggtatcgaggcaaagcggacaatctaccgtcgccgcaacttcatagatcacctgtttcatcatttctttttcgtcaatgccgttcattcccatattgatgtcaaggatggctgccccgttttcctcctgcgccattgccatctcacgcacaagatccagttttccttcgcgcagttgggcctgcagttttttctttccggtcggattgatccgctccccgaccaccaggaaattgccatccagaccaacttctacatttttgcgctcagacgcaagaatcctgcgatgcgatgcaagcggcctgtgaagttccatcccccgcgttgcatccgaaagtgccttgatatgcttttccgttgtaccgcagcatccacctacaatggctgctcccgcttttaccagtgccacacctgccccggcaaattcttccggtgtcatgcggtacaccgttttctttccctcgagttccgggagtccggcgtttggctttgcgatgagcggaatcgtagcatattctgccatcttttccaccagaggtaccatctccatcggaccggtagaacagtttacaccgatcgcatccacgcccagagactgcagtacgaccacagccgtctccggaggtgttccaaataatgtccgtccgtcttcgttgtaggtaagtgtcaccatgattggaagatcacagacttcccggatcgcaatcactgccgcacgacattcctgcagactcatcatggtttctaccacaaacagatccacccctgcttttgccagcaccgatgcctgttccttgtatacgtccaccagttcttcaaacaacaactctcccataggaaacagctgctggccggtcatcgtcatgtcacctgcaaccagtgcctgatcgcccaccgcctgccgggaaagtgctaccagctgcgtgttgatttcttccagcctctcctgcagaccatattcttccagtttgatccggtttccggtaaacgtggaggcatatacgatatggctgccggcttttacataccgtctctgcagatcgagcagtacctgcggattttccagcacccagctttccggacacactccaatcggcatacctgcctccatcagattcgttcccgttgcaccatctaaaataaccggaccatgttccctgataaatccggcaaattctgtctttgtcattttgcattcctcacttgcagtttcgtttcgttctatttataataataccgcagattatttctacgtcatgcgtaacaatatcataccttatcacagaaaaaaaagaaagtgagaatctatcatgaaagacataaaattagttgcactggatctcgacggtacgctgtttgacaacagcagccgcatcagcgaacgcaatcttacggcaatccgcagcattacagacaaaggcatccatgtcgtaatctccaccggccgcccatttgagggaatcccgtttgaccagatcaaaggcaccgggatcaactatgccatcaccgcaaacggcagcggaatctatgagatttccaccggaaaatgcctgtatgaaaatgccatggatgaagagctggtcaccccgattttaaacttccttctcacacgtgatatccatatggatgcatttatcggcggaaaaggctacaccccggtccagtgcgtagaaacagcacaaaaactgaccgtgccttcttcgatcaaaaactatattatcaccacacgcacacggctggacaatatcctgcagtttatccatgaaaatcagttaaaggtccagaaaatgactctgaatttctatccagcagccgatggaacactcattgaccgcgaaaccgtccgcaaatttctcgtgtccaatccgtcaattactaccgtctgcggcggatacaacaacctggaattcacgcgtgcagatgcaaacaagggcgttggcttacgaaaacttgccgaaattctcggtgtcaatccggatgccaccatggcaatcggtgacaccgaaaatgatcttgccatcattgaggctgccggtatcggtgtggcaatgggaaatgccactgatgccgtcaaagcccgggcagattacgtcaccacaacgaataccaaggacggggtggcagcggccatcgaacattttatcctgtaatttcactcaccgcgcaacaacccgatatttttctttaaagatgcaatgactgcatcaacctgccggcggtcggtctcccttcccatggtaaaacgtacactgcccggtgcataattttttggtacgtgtatggcttcaatcacatgggagatccgtgtctgtccggtattgcacgcagatcctgcggaagcacagattccgtcttcttcgagaagtaccagaagagacgtcgcatcaatcccctcaaaactgaaattcacatttcccggcaggcgcttatgcggatgcccattcaaccttccctgcggaatctcccgtaatacccgctccacaaaataattacgcagccgcacaagccgcggacgcacgacctgcatctcttccactgcaatttcaagtgcctttgccatccccacaattcctgccacattctcggttcctgcccgtttgccgttttcctgacttcctccgtgaatatacgacggcagatcccggtcttttctcacaaacaaaaaaccaacccctttcggaccgtggaatttatgtgcacttgcactcagataatccaccggaagctggttcatggaaagcggaatctgcccgatggcctgcaccgcatcggtgtgaaataatgttcccgtcccccgcagcatggatgcaaccgcatccagcggttcgatcgttccaatctcgttatttcccgtcataacggaaaccaatatggtatcttcccgcaacacctccagcaactgtgccagatcaatcactccgtatgcatcgacatccagataagtcagttcatatcccagtttctccagatattcacatgagcgcagcaccgcatgatgttcgattttgcttgtgatcacatgtttccctttttcctttttctccgccgccacatttttgattacccagttatccgattcgctccccccggatgtaaaaaaaatctcctccggctttgccttaatcagcatggcaatctgttctcttgccccttctaatgcctcccgtgtgcggcgccccatttcgtaagatgtggaggcgtttccatattcttccatgaaatacggctccatagccttgcgcacctgcggaagcatttcggttgtggccgcatgatccatatagattttacagctcatattctgcaccatcccctcatacaatagttatcaagttttccatttggagttcccattgaacatttcccgattcctaaaaaatcctctgattaccggcacccttctgatgacggcttccggtattgccagccgtatcatcggcttcttctataggatattcctggcacagacaattggtgcagaagcgctcggaatctatcagctgattgcacccgtttttgcaatgtgtttcgccctgactgcctcctccatccagacatccatttccaaatttgtcggcgatgcctgcggcaaaaacgcaggaacatcgcagggagaaataactgcacgcggatatctgctgctcggtctggtcatctcctgcacagcctctgtaatcgtcggtatttttctttacacacaggcagactggatcgccctgcattttctcggagagctccgctgcgctcccctcctttcgctccttagcttttccatgcttccctgctgcatccacgcctgtatcaacggttattactatggaaaaaagcgggcaggaattccctcgttctgtcagctggtggaacagcttgcacgcgtgggaagtgtatggctgatctatcagtacacgctggaaaaaggcatggagctgacggcgttccacgcggttgccggtcttgtggccggggaatgttccggtcttatcaccagtctgattgccatgtctttggaaaaacggcttcccggacactcctaccacaccctttccggtcagtggaaaacgatgggcaaactgtttgcttccatggcggttccgcttaccatcaaccgggtgacgacagctcttttcaacagcctggagaatcttctgatcccgcaaaaacttcaggcatttggttacagtgcttcggatgccctgagtatttttggtatcctgaccggtatgaccatgtccatcattctgtttcccagtgtactgaccaattccttttccgtccttttacttccggctgtctcggaagcccacagtgcacacaaccacgcacagattgcgcgaacgataaaaaaagcaatcctgtacggactgcttcttggctttgtttttacgattctgtttctggttttcggtgaccggatgggcgaagttctgtttcacaatacgctggccggcaattttatctgccagctctcctggctgtgtcccctgctgtatgtcaccagtctgctaaacagtattctacatggactcggcaatgcccggcaggttttgtttgtcacactgctggcatgcatgatcaggatctgcatgattctgtttctcgtcccacagtacggaatcgatgcatatctgtgggggatgctactgtcctatgtatttgctgcgattgcagacattcttttgcttatgccttattcccgtgccggatgattcctcactttttgatctccctcaggcagaaaaaacgccggtttccacagatcactctgccggaaccggcgtttctttatcaagacttttctattataaggtgcgattatacacgggacagatactcacctgttctggtatcaatcttgatcttgtctccctgctctacgaacagaggaacgtttacgtttgcacctgtctcaacagtagcaggcttggtagcacctgtagcggtatctcccttgaatcccggctctgtctctgtaatctcaagttctacgaaaagaggtggctctactgcaaatacattgcccttgtgagaacagatcttaaccatctcgttctccttaacaaacttcagtgcatcaccgacactgtcctttgtcaggtcaatctggtcataagtctctacatccatgaaatgatagaaatcatcatcagaatacagatactgcatgtccttacgatcaatgtgagcagtcggacacttctctgtcggacggaatgtcttttctactacaccaccactgacgatattttttaattttgttctaacgaatgctgcacccttacctggctttacatgctgaaattcgataatctgataaatgttaccttcaagttcgatggtaacaccatttctgaaatctcctgctgaaatcattcgatcttcctccttaaattacgagtataaagtctctcgacttacaattttactataaaatggaatacttttcaagtattttatttgttccgtttttcgatgtccgcaagcatagccacgcgtgtcgcatgacgtccaccaagaaattccgcattcagataagccttcacaatatcctttgccagctccactccgacaattcttgcaccaaacgcgatgatatttgcatcgttgtgctcttttaccagatgcgcggttgtcacatccgagcagacagctgcacgtactccgtttactttattggcagcaatggaaattccgacacccgttccacagatcaaaactgcacaatccacttctccgtcagccactgcacgtcctactttttctccgatctccggataattacagctttctgcggtatccaccccataatttacaacctcatgtcccatgctctcaataaattctttgatctgcattttcagttctactgctgcatgatcatttccaatcccgactttcatcacaactctccttttcgtttttgcacttcttttatcttactgcttcaacgaactttcgtcaaatagaaaacgaccggctgtgtacggtcacgcatagaaaattctgcaaaaagaaaatttatcctacaaaatggatgaatcctccttttttgcaacagatgggtactttggttttacgattttacggtgcagacgataacataaaagcacaattgcctccagccggcgctttaacacgatctggatttcttctttcgggtggatcggttttacaaggatcgtgcggattcctgctaaatttgccccacacacatccgtaaagatctgatctcccacaaaaagcgtatttgtcgcgtccgtgccaaggatccccatcgctttgcgatacccggacggctttggctttcctgctttgtaaatataactgacatgcacggcatcattgaacattttcacacgcggctccctgttgttcgaaagaagcatacaatgaaaacccagttcctttaaatgtgcaaacaaagaaatcgcccgctcatccgcaggcgctccatgtggtacgagggtgttatcaatatcaaatataattccccggtatccttctttatataattgatcaaaatctatactgtaagtggaatccagatattcatccggatatagaaatgcgcacataggtctctcctttgtgtgttatgtactaaagggaaaaattctctccggaacgcaaagcagaaatcccggtatccaacggggtcttcttcactccggtatcctgcgttcccacaaaatactgatactgctgcaacacctgatccttttccatatcggaaattgctttctgcatatcctgaaatattcataagcacctctggttacaaattcatccgagcatttttttcagctcattcataaatgtgtttacatctttgaattcacggtataccgatgcgaaacgcacgtaggcaaccggatctaaatcctttaacttatccatgagaatttcaccgatcaaagcacttggtatctctttttcctcacggttaaaaatttcgatttccacatcatccacaagttttgagatctgttctgccgaaattggccgcttgtgacatgcaagcaatacacctttttcgatttttgtccggttgtactgctcacgattgttatctttttttataatgatcaggggaatggtttccaccttttcataagttgtaaaacgctttccgcaatcatcgcaaagtcttcttctgcgaatcgaattattgtcatccgcaggacgcgaatcaatcactcttgtattttcactgctgcaatacggacatttcataggatttctcctcctgcatccaatcccaaaatatatgactatttttataatacacaattttcctgttttctgtcaatctgcaaatttttatccttttatccggtgtttcatttctttttcatcaaactctacgagtattatatcgggtcctatccggataactttagcccatggaataaaaaattcgctgtccctgcaaaaacaacccagatattttcccggtcctggaacgatcagtgccagaattctcccacactctttgtcaatatccagatcccggacactgccaaggcagcggcagtcttttacattgactacttctttttcacataaatcagaaaaacgcacagaacactcctgcttttctttcttggaatattctatgcgtcttagctgtattttatgtttatgcacgctgcttcattttataatatataagctgtgccacttctgcggcacagcttataaaaagggaagatttaagttttattcttttacgccaccaagcgtaagtcctgttacgaaatacttctgtaagaatggataaatacagatgatcggcagaatcgtaataatcgttgcagctgcacgaaccgatgtcggtgtaaccgttcccgctgcattcttcattgcctcgacactactgctcgtatttgttacggatgacagtagtttcatcaactcatactgtaaggttgtcagtttgccgttcatacggttatataacattgcatcaaaccatgaattccactgaccaactgcaacaaacaatgcaacagttgcatataccggcttacagagcggtgaatagattttcaggaaaatcgtcgtatacccagcaccgtcgagctgtgccgactcctctaagctgtccgggataccgttcatataagtacggataaccagcatgttaaacgcactgaccattccagggataacatatacccagaagctgttggtaagtcccagtcccttgtacaacaggaatgtcgggatcagacctccgtttacatacatggtgataacccagaataaagagagctgctttttaaacataaatctttttctgctgacgataaatgctaggattgcattggagatcagcgcaagaactgttccgatcacagttcttgcaaccgtaacataagcacctgtgatcaggttgtctttctgaagtaccgtaatgtagttcttccatgtaaattttctcggtaacagatagatacctccacgaagggaatccgtaccgtcatttaatgatattgctaatgtatttaacacaggatacagtgtaatgattacaaacaggatcataatgatcgtattgacaatcggaaaaatctgcaccttttttttcgctttttttgctgccattgtataacctccttagaacaattgttcttcaccattacgctttgcaatctggtttgcaatcacgatcagaataatacttacgaaactcttgaagataccggctgcagttccgattgcgaaatcgccctgactgattccccattttaatacgtaaatatcaattgtctgtgatactttctgaaccagaccgtttcctaacaaatactgaacttcaaaaccggcgttcagtacattacctacattcatcagaagaagaatgataatggttggtttaatacccggaagtgtaacatgcttgatttttgcccatctgcctgcaccatcgatagctgcagcttcgtaaagtgacgggtcgatcgaagtaattgctgccaaataaataattgcattccatcctgtttctttccagacattggcaaatgcaacgattggccagaaataacccggatgagcaaagaaattgatcggctgtgaaataatatggaagttaagtaataattcgttcacaattccgccaccggataacatatcgtgtaagataccggttacaatgatccatgaaaggaaatgcggaagataagaaattgtctgaacgacttttttaccgcctttgcttttaatttcatttaataaaattgcaaaaacaattgctgtaataaatgttaccaccagattgataacacccattgccaacgtatttctgattacccggataaaagtcatatccgagaataatgtccggaatttatcccatcctacaaattgcgaatgaaagataccaagtctcggtttatagttttgaaacgccatagtccagcctgcaagtgggaggtaatagaaaaccacgccatacactaccatgattgccgcccagaacaataatactttctgtcttttaatctctttccaggtaattttcgtcttcggttctttcactttctgtttggattttgttctctctatagacatgacctcactccttttttaaacgggcagatggagttttcacaacatctgcccatctaaaacctcattctctatgtattattcgtattttgctgcgtctttcatccgcttatcaagctctgcctgcaactcgctaaggaaagcgtccggattgcatgcattgtatgcatccatataagttttccatgcactgtcaaagtcttttgccattacaacctgcggaagctgctcatgcttaacttcgccaatcttggtccatgccattccaccctctgtgtctgttgtaaagttgtttgagaatgaccacatcggataccatggaccaggtgcctcgtttgttccaagcatctcaacgtatgtttcaacaccatatgcctggaatgctttcttaacatcatcatttaatccgtcaaagaattcttttgcctgtccactcggctttgttgcattcagaccgtcatcacaggttccgtcatactgtggaaaataggaataagaacatgcgtgagatgccttataatccgtctctgcagcctttgctctctgctccttggttctatagaaaagtccatcgtcgccaacctgataatcttcaccttcaacgccccagaaacgaaggttgtgaatttcctctgaaagaagatcatctacaaactgtaaagctgcttccacatcatcacaatcctttgtgattgcaagtccatcaccggaatttaaaactccgccggagttgtgccactggttcttacgtccatcaatcgttacaggtaccggaatgtaatcgcatccctgtgcatccagtcctgcagacttaattgcatcacctgctgagaaggcgaaatcccaccactggtcgatcataccaagtacacgtccggaagaaagctttgcaatgtactcatcataagtctgtgtgaatgactcaggatcaacaatacccttctgatattcctcgttcaacttcttgaagtactttacagcagtatcagatgtattataatccattacctttaatgtatccggatcaaccatacatgaaccatcatttggataaccatctaagaactgtggagcattctcaagacagaaatatctccaatcctcgcaaaggatggtatatggaatattctccgttccatcttccatggtaggatttgctgcattataatcttcaatcagcttgaaataatcatccatcgtcttgatttccggataattagcccactcaagaactcttgcctgaatccagaatgcctcatcgttatgcgtacaggttttctcttctcccttaatattggagaactgtggaatccagtaaatatgtccgtcgtcctgacgaagctgatcccattcctgttcggtgaagtagttcttgatattcggatatttgtcaatgtaatcatctaatgctaccaatgcacctgcatcatataactgcggcataccatttccaccacagatgaaatccggatattcatcaccggctaccagcgttccgattgcttcttctgccgtctggcctgtcagccatgtctcttttacctttacgccggtcttctcagcgatgatctgctgaacttcgttatcatcgttgatctcggatcccggaacagcaaagaaagctgtaaactctttaatatctccatcatttgctgcttttccaccctgtgtggaagaattgctgccgcctttatttccgcaaccggcgaacatggttgctgccatcgctactacaagcaaggcacttagcattctttttcttttcatagaatgtacctccttctttatattaactattttactttttttaccatttcaaacaatccgacgaattatagtcaaaaacagggtaaactatagttcattctgccggactataatttaccctgttttccatctctttctattccattttactgctgcatctgcttccggaattttgccggtgtgcatccttttacctgaataaagcggttgacaaaataatccagatcatggtatccaacctcttccgccacctgaataatcttcttatcggaatgcagaagaagatcggcagcctgatccatccggtaattattcagataatccttaaacgactgaccgtatttctttcggaacagttgtccgagataggcgctgttgacataatatttctcgctaagccccttgagtgtgaggttatccgcataatgttccttaatttctttctctacatttccgagaacacctctggatacattcttgcgaagctgggacagatagtctccgtactcacaggcgaaacgcatcagatgtgtcttactgccgcgcatcgttcctgtttcaaagctgctctccgaaatcagacgcaggatttcttcctgattgacctcatcatcctgctcgcttgcaagatggatcaactgaaaaagcagatagttaatattaagcgtcatggattccccacgcaggcctctctgactcatttctccatagaaacggtccaccgccgcccggatttccatatgattgttctgctccactaccttcagcaaatcatcaagactcttcttgcacaaaaccataccgtcattggacacctgcacttcttcctcgtagaaatagatgtcctttttgcttcgaaatccctgaaaggaacgaagcatacaggcattcccgtatgatcttgcaataaggctgatatcctgcacctttttcccgaccagcatcgtaaccgggcgcgacagattctcacccagatattccaccaacccgttcagataagcgttttcatcgagtcctgcctcttccgccatatattgaaaaaagatcaatcccacatcatatattttttcatctgccgatgcgtcaaacacacaattctccgcataatcattcaggaatgcagtacagcattcatacatctgtctttggaattcgcgcatctcctgatccgtcacatcttcgtccgcatcacattccgccatctgaatttcaacgtagcggacaccttctttgcatttcatctgtgatgtgacatattgcagattggaatcatcgtattttcccttgatcaaagcaatctgatttcttgcaagatatgccttttccattttattgttcttctgcctcatccggtcatcttcatcacgcatcgcagataccctgttaagcagtttcagcagcatatcacggtcaaccggctttaaaatataatccgtacattcattttgaagcgcccttcttgcatactcgaaatccgcatatccgcttaatatgacaaaatatgcattcgatagattttcttttcgtatcgcttcctgcagatccagccctgtcatgactggcatctgaatatctgcaattatcaggtctacactctcttttttcagaaaatcatatgcctcttttccatttgatgcagtccctgcaatcatatagccttcctgttcccagtcgatcagcacttttaatccctgaataataaaaggctcatcatctacaagcaaaacctttaacatatttctttcccccttttgcacaccggtccattaacacagccttcagcaaatgataaatactccatcggaatgcagatcgtaatccatgttcccacaccctcttcgccttcaatttcaaagcacacatgatcttctgtgtacattttaagccgcaggcatgcattgagcattcccacgcttttcttgtttttcagcatctcaatatccgcattctgcatatcatgctgcatctgatacaacttctgctcctcaattccgcttcccgtatcttcaatctcgatgtataattgttcttcccttttataagctcttacgaaaatccatcccggtgatgccttactttcgattccatgtacacaggcgttctccacaaaagttacaatcgtaagtttcggtatccggatctgcgcacattccggatcaatctcgagattgtaattcagccggtcaccaaaacgatatttctgcaaggacagatacgcttttacaaattcaagttcctgttcaatctctaccgaatcatttccccagtccacatattgtctttgcatgatcgccagtttttcgaccatatctgccgtctcgttttcttccttcaaaaggcttctcatgcggatactttccagcgcattaaacagaaaatgcggattgatctggctttgcaatgccaatagttctgcatttttcctgccgacaaggatttcctgttctttgatcttgttcttgtatacggtctggattagttcattggtccgtttgaccatccgattgtaattccggatcatgcttccaatctcatccctaccgtcttcgtgtgccatctgaacaagatgctcaccgttgacagactggaacactttgctcagcccacggattctctttgtaaacgaatgattgagaagcagcacaaatcccatcgggagaaccacattgatgatcaccagaaaaccaagaatcggaagaaaacgcacaatcttactccgcactctattatccgcttttaaaacataaatatcaagtttagctccgtgaagtgtaatggtctgtttgtatcccatcttctgctgtacactgatcatgtcaaattttttaccgacaccactgaaaggtccgttactcagtacgatcgcatccccttgacaaataagaacttcattgtcaaacttcattcgtctcagcatccgcatcatactgttataatcaaattcgatttgcagcatcttttccttattcttggaaaaaaaatcaagattctgcaataggatgatcttacgatgataggaattggcatatctcttacgctcatatacaaaaaaaagtccttcattttcgcctcgttccttccacgcttcatacgctgccgtttccttcagattggacatattatcaatctttccaccctttaccacggtaggattatccgtatacagggtaaagacgatctgattcatgccgagtacgttttccaacgtcgaatcctgaaagaaattctgatattccgcataataatccgaagtgctctcatattgcttctccaaaaaggtattcatccttctatcggtgtacatacttttggcaatttctcccgcattctccaccagtgcactgatattatagctgactgcattcgcaacgtttgccatctcatgatactgccgctgcgattccatgctgtcttcaatatataagacgacactgtccgtaatgatcagcggtaataaaacacagaaaatgtataactgtataaattttttcttaatagaaagattatccatatatctttccaataccttgatgaacttttcgatgatattcataccaacccctctaaattcacacacaacaaagcgataaaggagcagatttttcgacctgctcctcattcgtacaaccgattaaattcattataacatatacgagactatatttaaaattgtttcttgatatttctgcacgctaatactcaaccggtgtctgcgcaccctctctgcggaccaccaacgcagccacgtcacttccggtaagttttgcacttcttgcatccggctgctgactgcgacggtctgtatcttatttttatccaacggcaggaacgcattctcgtttttcaacagaacaagacttcttcttgccgcttcaacagacaacttcacatgttccggacattctactttatcataggtaatttcttcatacggggacggataatccttcatcatacccagacgaatacgaacttccatcaggcgctccaccgcttctgtgatcgcctcctcggaaacaagtcccttctcgtaagcttcctgcatatcctgcaggagagttttgcttccacacgccggctcttgcaacaccatgcaaagcctcattccaccagttatatgccggaatattaagtcgctcgatcgccggtgactcatagagcatctggctcattttttcctcaaccgtcatctgtgcaaccagtttctttgcatattcttttgtctgtctattcattatttcattttctcatcttaaacactttctatcaatccatcgactggcatgtcagccattcaaaatcagcataatttgtactgtcactgccgttggaagacgcatatacaccgactgtgcatcctacaaagcctccggcttcctctgtcgtgtaagcaagaagatccagattttccgcaacggatacatatcctttgccttccgaaatccagacacgggcacactgattgcggcactgcaggcggatctttaattttcctttcttctccagccgtgttgttgccagcgtctgctcatctccgtgaatacagctggtaaccacaaaacaaacttctccatccacgcgcaccacttcaaaccggagatgattttcattattctggtaaagcacaagtcccgccgtctccgactcattttccggatagaattccattccggtctctgcgacaaagcggtaactcttctgtcttacaccaagatatgcacagtttgctctctcggaaatcttttctttgcgaaggtacatccgaagtgcaccctcacgttcggtcagcgaataaattccggatgtccagtcctcgatcgccaccagccgctgatccagctgttctccccagaaatgaatgacatcggaattcgtaatttcttccgcaaagcgatgctcaggcatatcgatcgtaaattcgtcctccagatgtccgactcccggagcgatcaccggccagccgttctcccagattaccctggcaaggaaagtctcacgccccatgctgctatgctttttgcaaggtcttgatgcaagcattacaacataccagtttcccttgccgtcatcaaccagatctccatgtcccgcatagatgaccggataatccataccgagattgcggtgtgtgaaaatcggattgcgcggacagccttcaaaccactggaacagcttcttactgcgtgccaccgtaatactatgttccggaccggttccgccttctgcgtggagtagataataataaccatcgatcttgtaaatatgcggaccttccggccagatacatccctttaccgcacctttccagattgccatgctctcaccgaccagcttcatggtcttaagatccaattcctgaatccaaatctcccagtccccgttatagcgaacgccctccggattcggacgggttccgcaataataacatttgccgtcatcgtcgaaaaaaaggctcggatcgatgcccggggcatcgtcgccgagataatacggctcggaccacggtccttccggattctccgctgtgacgataaaattgttgccgtgcgtcacattggtcgtgatcatataaaacaaaccatcatgatagcggatcgtcggcgcataaataccatctgagatatccgctcccgccacaggaagctgcgacggacggtctaaaatattaccgatctgctcccaatgtgcgagatctctgctgtgaaagatcggcactcccggtgcatacacaaaacttgaattgacgatataataatcctctccctttctgcaaatggaagggtccggataaaatcccattaaaatcggattcttaactgtaaccattttactcctccttataacacgtaaccaaatcctaaaattgtaaacttcttgtctctgtcttcttctgcgacttcaatgcgtaccgtatggtcggcgctttcatcctcattgaacacgatcatcgcgttgcagtgctgccagttgttaatatgcggatccgccgtcatgcgacgctcaccgtccacatcgacatacgcctttccaacgtccacttctccggaatccttaaagatcaacacaagcgctttgcaatggatgcggattgtaaagacagcattctccgtcatcgttgcatcgtacatccaattgtacggaaactccggtgtcaattctaaccggtcatccatctccacactctggagctgatcatccgttgcacagaagccaccggcgtcgatttgggccccggcatagacatctttcttatccagaagccgtacatgctcaaagcttttgccgattgccggcttcatctgcagctgctgtgcaagcattccctcctcggtcaggccgctctcaaaagcgtcaagtcttgcatgttcgctcaaatcacagcgctcaaacagatactgtaaacagtctgccataatggtatggccgaggttgctcggatgaaacatatcgtaaaagaactgattttttgtcagaacccttccctcgttcggtttctttgtaaactgctccactacggtatccttgatactgaccatcggcagatcatacagtctgccgaccggacttaagcgatcctgcagattccagtcattggcaaatacggaaaaaagcagaacgaccgccggattccaatccagctttaagatcttgcgcacaaggctttcgtagcaatcgcccttcgtctcgtcaccctcatcgttgaccgcaaattctacgactacgatatccggcttctcgccgtctcttaacacatctctgtcaaagcggagcattccaagctccgacggggttcctccaacgcccgctttcacaaatttaacgttatctctcatcgcaaatctgcttttgaaaagctgataggacttataggcataacactcggtattgatcggtgttgctcccgccccttgcgtgatcgaacctccgatataggcaagcgttacttcttttccggctctcgccttctcgatcgctttgcggatacggtaggtgttgcccagattcatgagagaacgctcgatcatcgtgcagtaccgttccgatttcgtatccaccgcttcttcttccacctcttccggagccgtatatccgtcgttcagataaaaccgaacgctcgcttttcccatcttttccggtgcgctcatgatgaacttgatctgtcccggaatataatcatcctctgtccaggtataatccgacagataaatgcgccgttccattccgtctccggtcaggctgcatcgcagattggttccgcctccgtagagatcttttttcccgtacatctggaagatgaactccatctcctcctttggattgtcggtctcaacagacaccccgatactgtgtacaagcttgccgaatccctccaccgtctccaataaccgaagcatgttctcatccgtaatatttccgacgatctgtgcgctgttgatcagtcttccgtcactttcatagataaagtggatcgcacttccgtcttcctgttttgctccgaagatttctttatccttcataatgtaaaaatatggtcttttcttctccggatcctttggtgctgccggtccattcataatcattacctccttgccttcttgaccttcttttctttatacatttacgcttttttcctgattttcctgattcagatggatcggtgcaaaatcaacaacgttcttattactgcttgatttcttttgggattatgcttttcttgtgatttgattataaaaaaagcccccgcttgcgtcacgagggctttttatggaataattaccgacaaactatagtaattgtattcctgtcaatattttctatcgaacgactatcttcatggataccgtttttgtttttccattctttaaagtcacggtcgccttgatcgttaccgttcctttcctgtttgctttgatcttaccgttcttgtttacggtagcaatcgacttcttggaagttttgtaagttaccttctttacattgttctgattcagcttgctgtcaagcttaaactccgttgtttttccttttttaaccgttgcctttgctttcttcggagcgatggtcttaaggatttctttttcaattctggctgcttcctttgtcgtcagaagtacataatcgcccttctttccaaaacttacattcagatttccgtcctcagccttataggtcttgctgttgatcagttcatattcacccgtcttacggttgacaacaaatgccttcagtgatttattatttttcacattctttgcggaaacggaaaccgtgtatttcacatcaccattcgcattcttaacctgcaggatgatcgtaagatcttcggttcctgccgcctcggtaagctgctttaccacatctgcggtaagtgttccctttgatcccgataccgttgcatttgcgctggtcacatttccctgcgcatcctttgttatggttaccgatgcctcagccttcttatcgccggaaactgtaatttccactttggatgtctcaatggtcgtatcctgttttccgtccggtttcacatccggcttcgtatcctgttttccgttcggtttcacatccggcttcgtatccgaagttcccggatttacagacgagccgccgccattgctgccggtctttccggttaattcgaccgtaccatatacgtttgagcctgaccagcccattccggtctcatcataccaacttaacgtaccgatacgcttgccgccttttgcatcgttgatctggagttccagaccaatcttggttccgtttgccggcttgatatccgtccacttgaaagcagcctcaaccacgtatccgccatcgattgtttttgttgcagacttgacattctctgccagacattttttaccattgaaggactgcccattgttataattgatacgatactgcttatcgtcctctccataggaagcggtcttgccgttgtcctcgtcgatgaacacttcaagagaatcctgctcatgcgtctgagcgcctgttttatccaataccgcgtcgtttacggttgcatatacatagagattgtcatcatcccagagaacctttgcattggcagaagcctcggagcctttgttgatcgtaagcgggatgtttaccgcattgccccatgcggcatctgcatctgcgtcaaccgaaattgttccgtacgggatcttctcgatgcccggcttcatggttgccactgcataatacttgctgcttgactcctgctttccggtcagatcattaaagcttcctgtctccccgtcattgtttacaacaacatcgagactgatctgctgtgcaactttcaaacccttcatcgaaaccttgacggttgcctgatatccgcctgcgatcgcagcagcagctgttcttgcaaccgtcaccttatgtggtgtgatatccgatgccgaattgtccggatctacatataccgtaacggcatctgcgtcatttacggttgtatcttttacttttacctgtacggtaagaccgtctgcatcccaaaccgggataaattctgcctgtaccgcaccctgatcgatcgtataggtttctcctgcaatattgccatccttcgcctctgtaatggtaaccttctgaatcgccggctgaagtttcgttgcatccacataagcccaataagcaggctttgctttatagtttccgtcaaaaagcagtgggcactgtgcagagccgcttgctccgccaccgagatccgactgggaatgcagccatgaattcggctcaatgacaccccagacggtaatgccggatacgtttgctccttccttctttaacgccttgatcgcctcatacagattcttatggcagtatgccatcttggtgtattcgctttcctttgtagccgctgtaccatcgtaggtactgcttgccttaaaatccagctcagtcagctgcactttgccggctgcctgtgcatacttcttcgctacactcttaaactgtgcagccgaaaaaccgtccacattgtaatgtgcctgcataccaaaagcatccagtctggttccatctgcagacttcacgtcgttgatcagttttacgataccctcacacttggtgttgtctgtctctccgaagtcattgtagtaaagttctacatcatttggcgcatatttgtttgcatacttgaaagcattgatgatgaattcgttgctcttgtatactctccaccacatggaattgcttccatgacgggtatccgatgtacttgtatcacttgcatcagaaataaccttatcatcacggtatgtattgccattgaccgcctcatttacaacatcccagccataaaagagtccgtcatactttccgtttgcagcctttccaaaataatgatcaaacacactgaaaataaaccactccagtctgcggttcatagttcccttatctgcgtatggctttgcaacatcatagtcctcgtggaagaaccattccggagtctgtgaatgccataccagcacatgaccgcggacgcgaatcttatcgttcggattagcattattccactcaagaattttgtccagcattgcatccgcgcgtgagaaatctaaattctcttgcttatcattaacaaccggcaccttcagttccttcccttggaacgtaattgttgtagaatcaacagactgtccgatctgatagttaaacagtgcatccggctttaactcgtttccgaatgtcaccgcattgaaatgcttcttgacaagtgccatcaacgtatcatctgaaatctcacttgacatgatggcagtacctgcgatcgaaccagttccaagacttcctgtaacggatgctttccaatccggaatgttctcttcgatctccggttttggttttgtgatctttttcatggatacatttgccacatagtattttcccatgatacaggaacctggttcctgccaatctccctgttccaaaatacgaatcacaaccttcttcgcacctgatggaatcttgtatgttccttcgaatttcgtccattttccagcttcaagaatctgcgcggatgtaccggaaatcagtcctgttgtatcatactcctgcttaccatctccattctcataatacggctgaaattgaacagttttctgagaatctttcaattctttattataatcatccgacaattttgcccaaaaagaaaactcatattcttcgccttcgcttacgttttccgtgatgtcctgtgcaaaacattcatatgattttgacggatcttgggatcttgtaatagcaccacatgttgtaacaccaatatcagctccattttcaacaggttccgctgtaatcgtagcatctccttttgaagcactccaggatgagaaatcctgatttgaaaaatctccattatcaatgatgttctcgccatgagtaatctggcttccgcttccttcttttaacgttacaaccacactggtcaaacaaaatgacgcatcattctgggttgtcataattacgactttatcaaacgttccttccgtcttttccggaacgatcgtatattgtttctgtccattctgaccatagcatgcttccacatcatcataccagcccgatgcatttgtcattccaagcttcaaagcaataacgccttcctgacttttaacattgaaggtaacagactctacatttgcaagatcaaaggactcagacaaattccatactgcctgtggatacttgtgctctgcatcatcatgtttcagcacaacattccaaccttcttcccctgattcacaggaagttccatcagcgccacctgcaaaagcctttgtcagctggttcgcggcgaacgtcttggttgttgtctgtgtctcatccgcatataccgtatcaataccccaatccgacggcagcataccgcctacactcgtgagcatcattgccgcggatagtgcaatacacgcccccattttccacatttttcccactcctattttcctccttaaatagattttcgtgtaccttaatagtagcaaaatcaaagccgacaaaaacagggaaaaactatagaagaacagccgacaaattgcagtaaaataattcaggtttgccggcttggattttgaacaaggcgtgtaatttgttgtgatgttttagtgatttttgtcccgcatgctgggacacttccaatccttattctgcttgttttaacgttgtacataaaataaatcacgcgcggcgaaattttacatttactggtaaaataacaccgcgcgtcaatttacttaaaggctatctgcgcaaaattaaaaaagccgagataccagatatgaaaatcatgcatgccttttaattcctgccagataaaattatcaggttccgttaatttatcgcataaatcaggaagattctttgcagctgctgccgcgctgtcgtacgcgatctcatcctccattccgcagatattgtaaaaataatcaacggtatatggagtatcctctaatatttttgccgtcttctccgccagattgctggtcggtgctgcggaaaatgcaccaaaataactgaacagatccatacattctccgattccgatgttaatcgtctgcatccctcccatcgaaagtcccgccatcgctctgtgcattcttgaagcacttggatctccttccaccgcataggtcgaatagtgcgcttccatatacgggatcagatccgaacgcaattctttgccaaacacataaaacgagttataatccgaaccttctcttgcacagttttcggtggagcgtccgtttggtgtcaccacgatgaacggctcgatttctttgtaatagatcagattgtccatcattctttttaccagcgaatcctcatcaaccattccccactcggcttcgtctccaccgattccgtgcatcaggtagagcacgttgtactttttatcccggctgtaaccatacggaagataaacatttgcttcctttgtgatttcttttccagctagaaaataatcttttgacgagtagcggatatgctcgatcactccggcctcatcggctctcttctgctgatatttttccggaatgctttgtgcattcacatgtaccttgccgttttcctgtgcgatcgccttttggatcatttccgcactgtgtcccactttctccaccttttccaatacctcattttctaatcatcatttctaatagatccggtaatttcccgataaagcaagcatcgcaaacatatacaaaaaattgtcgtaataccgtctctcaccggttctaagaggtgtgttccagaatttgtcaacacattgtttcgcataagttccgtccgcagccagtgcactttcggcattgaccgcaatgatggctaccggatgcagtgctttctcctccagtctggttccgtcggtcaaaaagacaccgtcccagtgatccttctgatcctcgcagtagaatttctggaatttctctgcaatctgcacctgccacgggtccttgtcaaaccacagatggtccatcgcgatatttgcgatcgtgcgataggcatcactgtaataccagtcgtggcggccgaagatctcctgatgcgcgctgtgcggggttccgtcataatccgcatactctgccgacaatccggtatccggatgacaggctttatgcaggtaggcccggcttgcttcggcagcgcctttccagaacttacgatcctcctcatcggcatattccgcaaaaagctcgtaaaaatgcggcagatgatacgatggatcactaaaatccagtcccgggacaaatttgatcagtttgttggaaggctcccacatcggatcgcccggatgtcccggttctcccttatgcacacactcatgcaggatcgcttttgcctccctgctgtaattaaaaatgccctctccgtctccccatcttcttgatgcaaagaacaatgccatagcaaaatactcttccccgtccggtgctggtccgtccgcatttcttgtgccgtccaaagcgcaggaccatgcaaaataattctttcccggtccttcatccatatacatataagttcttgtccacttccacagacggtcaaattcctctttcttatccagctgtacacaaaccatcatgccatacgacatgccctcggtccgcgcatcatgattgccggtatcttccataaatcccatatcctccccggcttcatggtaaaagcgctcctcttcgctgccatgaaaaatcgtctcaaatgtctcctgtactcttttttcgatttcttcttccgaataaccatactccgcaaatacattgcggtactgttttgtttcataagctcctgccatatttttctccttcctctttcggtcagcccatgccaaatttcctttccgcaaatggactgacatgctcctcactgtattgatatatgatcagctcctgcaccgatacgtttctgtcggtccaagataggcttctgccggtttgtttccatggggatagatcacgatcttctcaagaacaaagcccggtgtaaccggagtgaccctgatcgtattgattccctgttccagctgcaccggtacactccggcgccggatctgatccagcacaccgcgcgcccacacaggctgatgatctccgatcttaaaatcatccgtaacagcatccaaaatctgcattggaacaccgttcacggacactgcatactgcaatcggttctctgttgtcacaggattcgacggctgcatatagaattccgcttcataatcccccgcctgctttgtcacgatgctgtattcgatatacggtgccccattctctgcatctgcgtaggaatccgtcggaaatgctttcatcgcagataaagtctttccgtagccggcaagacatttccattgcatcggttgtccttcccgatcaaaaccatccttgcatctgctgtaatgttccgcctcgattgcgatccatccctgtgtatccacaaacgtattgtttccatattcatacgttgaccggtcgaccggcacgctgatcttgcagatgcccgccggcaattccagccggatcattccctgcgttcttccatcggtgagtgccatcgcaagcgcgctctcgtccactgtgacatcaatggtgagtctcttgtgctcttcaccgtcaagcgttccatccattgcggacagtacgatccattcggccttttcgatcacccgaaacgatgctggaagttcgcttctgctgtacaggctgatcgaagcacatctgcattccggattcagaaaatccgaaatcgtcattctctgattcagccacggactgccttccacatgctgcacggtaccgtccaccgtcgctataatcgtcggcttttgcagcggtaacacctgcatcagaagcgggttcttacactcatcctcattccaattcgtaaacccgatatgctgcgacagtcccattccgtaccagcgcgcatcatccgaccgatgatactgttctatgatcttttggtctgcatccagacatgcctttgcctctttcgcataatcattggcactgagtgcaccgatttctgccagataatgattcattcctgacaacagctgaagcttcagcacattcatcgttcccatcgccggataccagacgagcgcaacataagcgggaagtatttcgggcgcatcacgctccagctcatcgtacaaatcctgtgcggtctgcatcacccgcccggcctccgcaagcacccgtgagccttcacgataatttgctgcatgataggtttccggtcttaacgcctccggtctgcatttgtgtatcatccttgtataatctgtcaggatatccgcaatctgcgcctgctgcacttccgacagcctgccaaattgccgctttacccacagtctggtataggcatccgtcgtatttggtgcagtcgttccccaacgctcaaaatcataagccagatccataaaaaacgataacggaaattcctgcgttgcaatgtctcccacattgacgatccagagtttttgtactccgaaatcatatgcctgcgtcatctgttcccagattttcggaagataggaactgttgatccactcataggaggtcggccacccatgataatcgaaatgataatacataccgtatccgcccggatgcttacgcatctcctccgtcggaagcgttcttaagttcccgtaattgtcatcgcaaagcatgaggatcacatcataaagctccttggatccgatcaacccctgcgtcgtctcatccccgtagaagaaagcctccacctccttgtacaaagcgatcattctcggaactttcgacagatcttcattgacattctcccggatcagctttcgctgcgttctgagcacgtccctgagcagttcaatattgtccgcaagcgttgccccttttcccatgatcgcggtgtccgcttctccacgcataccaaccgtgatcacattctcaaatttaccgctccgcttcagaccatcttcccagaatcttatgattccttcccggttcgtcttgaaattccacgcatctccgtaaatactgtcttttccgcgcagatatttgtattcctcaccctgccgcagacacggctcatgatgcgacattcccatgatcacgccgtactcatccgcaagttctgcgttcagaagtcccggaccgtcatcctcaaaccgcgcactccacatcgccggccagagataatttcctttcaggcgaagaagcagttcaaagatcggctcgtatgccttcgcattcggtcccccgaaatggtactcactccaggtaccgaaagcaggccactcatcattaataaagaatcccctgtattccaccgatggttcctttgcaatacatgccatatccgtgctcagccggatttcatcccgatgcaccggcaccacatgacaccagttcacaaacggggatacaccaaagatctccgacaaatgaaacagtccgtatatcgttccccgcttatcgcttccgacaatgacaagcagtctctcccgcaagccatcatccgggaaaaaccatccgtagcactcccgttttccttttaacacatccgtcgggatatttttctgtgcatccagccacctgctatgctccatcgttgcgacaatgatcgtcagttcacgggctgcactgcttcttacctcttcatgatcgatcgtttcgacaacacggatttccggcagcgtgccggtcacaagttccatgtcatgtgcaacttttcctgcgatcttcaaaaccccggaatacgcactctgttctatgataaatttcatgttgcgctcccttttccactatttttattcttatccgtataaatcgtgattaccggctgtccttccacaaccgtaagggttccatacatagatgccgtttccatccatttcagtgcaatactgtccgtatagatgaccggtctggtaatcgtttcaccgtcatacatgattccgttattttcgataaatatccgacatccgcgccccgtatgatcgattccctgcactagataacgagccgataattttgatggctgatccttataataaatctgcgtatccacaccgcccggaaggatctctcctctgaaataatctccatcgcaccttccgtcaaacgaaatcatctgtacggtagcgcattcagattccaccttctcgcagccattcacatgaatatacaatttcaacacttccatttacttctccccatctgcctgtcctttcattgctcagcgtaaataaaaatccccatccgtgtacgatcaaaaatatcgcactatgaatgaggattttatttctatcacttatatcacataattgtcgtattattgaagaatctgatccacatgcctctgcaggatatcgaaatagtcctgtggattgcattcctgatatgcagccatatatgcatcccatgtcgatgcaaagtcatcgctcatgatcacctgcggtaaccagcttctcttgaccgcgtcgatttcatcacgaatcatgccgcctttggattttgatgacaaagactgtgtatacgaatacatcggataccatgcgccgggcgcttcatttgttcccagcagctcgacatagttttgtacaccatacgcttcaaaacactcccgtatgtcgggctttaggcttttcataaactccaccggctgatactccatcgaaaatgcattgattccgtcgtcaagcagaccttctactcgtggaaaatacgaatacggacaaaaatgagattcattcagcacgctgtctccgtgacgttttccctgttcactattcatatagaacataccgttttcgtccaccgaatagtccaggtctttttctccccagaatcgaagcttcgtaatatcggaatccagcagatcatttacaaactgaagtgccccctgcacatcttcacaggatgtggtaatcgaaagtccgctcgatgtatccatctctgcattccggcttgtatgccactggtttgacgtacctttgtccattgtaatcggaagcggaacataatcgcaccccagatcactcagtccgtttgtctcataaggctctgccagattgtaatagaactgccaccattggtcaaccattccgagaacagcaccggttcctaatttatccagatattcttcgtatgtactggtaaacgactgcggatcaaaaatacccttgcggtactcttcgttcagcttctgaaaataccgtctggcagtctccgtcgtattataatcaatgacctgatcattcccgggatcaaccatacaacttccgtcattgggatatccatccagaaactgcggcacattctccagacagaagaatctccagtcatcgcacaacatggtaaacggaacattttttgttccgcccggcatgaccggattcgcctgcacataagcttcgatcagatcaaaatattcatccaccgttgtaatcttcggatatccggcccattttaaaacgcgcgtctgtatccagaatgcctcgcccgtatgcgtcacttcaacattctctccctgagacacacaaaactgtggaatccagtaaatatgtccgtcttcctgccggaagcgctcccactgttcctccgaaagataattcctgatattcggataatcatcccagtattcatcaatcgggatcaaagcatctgcctccagtaatgctttctctccaagaataaaatccggatattctcccgaagcaatgtacgaattgagcacctcttccttggattgtccaaccagccagttctcctcgcagtctgctccgatcttgtcagcaatgatttcctttatatcgttctgcattcccagtggtctgcccgtaacactgaaaaaagcggtaaaatgtttaatttccggtttctgcctatattgaacgttgtaactgtatcccccaagtacaataagcaatccaatcacaactaaagttgatacgattttctttttcatataactctaccttctcctcaaaagctttcttttattatagctttttttctgtcaaaggacaagcaatcgcatccgcaagcacggttaaagtgatatattctctcctcttaatccattaaatgcacccttgatggcagcctcctcatgtgcgatcagccacttgtttttcgcggtcataagtttgtcctcaccatctgctgcaagggtaaaatcaatcggtgtgtttgtacccttcggcaagatcacaacacacttaaatccaccgtctgctgcgttgcacggtgcataatgaagtgtcgtctcatacatttcaacgaccgttcctgccggaaccttaaaagcctcgatttttgctgtatcataagtaaattcatccgttacatccggcagccatcccaataaaaggatcatatccgttaccgcaatgttgatttcggaatttctatgatattctaccgcgtttaacttgtgattgtttccgttgcagtaaccaatctggattggaagtccgccaaagacacgctcgctgaatgtctttgcttccggaaccgcttcaagctcctcgactgatggcacataaataacatcctccggaagcggtgtgtgctccatcccctttatcagttttgtgcattcgatgttattccaaaccttaccgtatttacggaatttttcatcattaacagaaaaaatctccatgattacctcctcatactcattttttctgagtataacagtttggtagccatggagacatgcctttctttgtctttacaatgtcacttttttgtctttttccagcaatgcccgatgatgggcatatgattccctctgctttttcttaacaagctgctttcggtattcactcgtcagcattccataccgcttgcgaaacagattggtaaacgctttactattggcaaatccatgatcaaatgcaatatccacgatctgcttatccgtattttccaaatcctttaccgcatgttctaaccggatattttgcagataatccttataattgatgcccgcatagcgtgcaaacatttttgacagataagacggcgaatatccaaatattcccgccagttttccaagcgaaatatcttccatataatgatccttgagataggatgtaatcataccgagccggttcagctgctgattgcttttgagcaattcatcctgcacatccagcttcctgtatttctttaccagaatatgtaatagttgataaaacatacttaaaatttcaaaatcatagccatctgtctgcatccgatacaccttatacatccgaaagatcagacatgccacctgctcatcgtatgtccgttcactatgcgaaaaccagataaactgctcgcccgtaaagtacgacgcgaactgattcagcggaatctgcagcacaattgtgtgattcggcctgttcgcatggatcgcatgcacctcgttgctgttgacaatgatgaactcgccttctcccagatgataatgcgttgtgtcaagaataaaatcaagttctccttcctgcactgcaaaaatctcaatcgaccggtgccagtgtttctccctgatatattttccgctgtgtccctcgaataaaaaaagtttaaacggaaagcctttgtccggcacaataacctcatgttgatactgctgctctgtcatatgctcccacataactatcacatatttcttgactagacattaaatctgaaaagaatcacatcgccgtctttaaccacataatcctttccttccatgccaacgattcctttttctctggctgccgcaaggcttccgttatccagcagatcctgatagttgacaacctctgccttgataaatccacgttcaaaatccgtatggatctttccggctgcctgtggtgctttcgttccttctttaatcgtccaggcacgacactcatcctcccctgcggtaaggaaactgatcagtccaagcagacggtaacttgctgcaaccagcttgtcgagtccgctcgatgccaccccaagatcatcgagatattctttcttttcctcctcggaaagttcggaaagttcctgttcaatctgtgcacagatcacaaatacttctgcgccttcttcctttgccatctcacgaacctttgccacatgcgggttggaagctccatcgtctacaagatcatcctctgctacatttgccgcataaatagtaggctttgcggtaaggagattgtatcccttaaaccagatctgtgcatcatcatcgtccggtacttcaaatgttcttgccatcttgccatcctcaaggtgtgccttcactgcctcaaccagctccagttccttggcaagtgtcttgtccattcttgcctgcttggcaattttggcaattctacggtcaagaatttcgatatcggagaaaataagctccagattaattgtctcaatatcgcgcgccggatcaatggaaccgtcgacgtggataatattggtatcctcgaaacaacgcactacatgtacaatcgcatcgacttccctgatattggcaaggaactggtttccgagtccctctcccttgctggcaccttttacaagtcctgcaatatcaacaaattcgattgtggcaggtgtcaccttttttgtatgataaagctcaccgagctttacgattctctcatctggaaccgaaacgattcctacgtttggatcgatggtcgcaaacggatagttcgcagacagtgcacctgctttggtcagtgagttgaataatgtactttttcccacgtttgggagtccgacaatgccgagtttcatgatatatatttctcctttgaaaagtattgtaagctaataaaaacaatatatagtgtaccacattaatgcttaattgtacaattatttctccctagctgccagaatgccacggcacttgccgccgctacattgagcgaatccacgccatgcgccatcgggatacagaccgtataatcgcagtccgcaatcgtatgtcctgccagaccatccccttccgtgccaagcacgacagccagcttttcttccgcagccagtgccggatcatcaattccaaccgaatccccggaaagtgccatggctgccacacgaaatcccattttatgcaaatggtcaatgtccgctcctgccgcctgaccgggtggatttttcatcccgttttccatctgcagatatgtccacggaatctgaaatacggttcccatgctcacccggatggcgcgccggtacagcggatcactgcatcccggcgtcagaagcaccgcatccatatgaagcgcagccgccgaacggaaaatagcaccgacattggttggatttaccacgttttcgagtactgcaatgcgtctggctttggcacaaatctcctccggttcctgcagctttggccgatacatggcacaaagtgcccctctggtcagagcaaaaccggtcagctttgtcagcacatcaaattctgccgtatacaccggaatatccccgcatctttcgatcatttcttttgcttctccctgaacatgttttgtttccataagcaaagacaccggtatgcatcccgcatccagtgcccgctcaatcaccttgggactttcggcaataaatattccttcttccggatgcgcacggttcagcagctgattttcggtcagccgcgcgtacacatccagctccggtgccataaaatccgttatttttattctttgactcactgttacgtccacctttgttcaaactttttttattatcccaaaatgcacgcatgattgcaagtctattcgtaatcttttacattagaactgtcaactttttcaaatggcacccatacataaaggccatccttcgttgccccttccagttttgttacatccgaaccatttgccacagcaatcgcagtctctacaaccatctttccctgtccaacacctgactgatagacggtaaatgccatatctcccgcctcgatcgctgcacatccaccggccgtcgcatcaataccaagaattggcataccgtttattcctgcctctttgcatgcatcgacaattcccatcgccatggaatcgttgttacatgccacaacatcacaggactgtccggtctttaagaaaagttcaaacatcttctgtgccgttgcctgatcccagtctgcattatcctcaaatacataattgattttcttgccggacgcattcaatgtatccttcaatgcacccgtacgtcctttcgttgccgaatggttccttggtcccttgaagattgccacattgatttcatccgaagaagaaaacttatccagaatatactctgcctgatactgtcccgctacattttcatcggaacccacatacatatattttccggtctccagatacgatgcatccggacaactgttataaaagataacaggaattccgtctgccagtgattccagttccagcgcggtatctgcattaaccggtccacataaaatcacatcgtatttttcttttgctgcctgtttgatatgttccacctgactctccagggaaccatcctcatcatagacatccagtgttgcacctttttcctgtgccgtcttttttgcctgttccacaatcgtgttgcggaaatcatctccctgtgacaacgacatcatgattttgattccgtttccgctgccggatttgcctccggtactgccgcatcctgccatgcagcccacaagaagcagggcgcatatcatacaactgattactttcttcatgaccttttaccctcctatatctgaaactgcttgacctgatccgccagctggtctgcagattctgccagatttccggcttccgcttccacctgttcactgttcttggaaatactctttgcctgctggagcatggattccgaagtggcaagaatttcatccgaacttgccgcctgttcttcggaaattgcggcaacattggttgccacctgatccacctggttgattttttctaccacaccctctatcagatggctggtttcctggatattctggaaaatctggtcaaatgtatccaccgctatatgaatcagatccgcgctgctttcgatatcgcttgcactgcttccggcctgtttgacggcatcatccacaagtccgttaatttcattgatgagtgatgtaatatgcgctaccgaatccgcactgttttttgcaagtaccccaatctgtgaggcaactaccgcaaatccgcgtccggcttcccctgcacgcgctgcttcaatcgatgcatttaaggagagcagatttgtttcctctgcaatatccccgatcagttttataatatctacgatttctccggaagccgtacccactttatcaaccgcttcttcgaggttatgtatggaaatttcgatattatgaagcgcatttccaacgctctccatatcggcttttcctttttctgatacttccacagtggtacgcatcttatcttctactttatcgctgtcctctttggtatccgcaacaacaccggcaagctgggttgcgttctgtgcaatttcattgacggaaaccgacagctgatcaaccgttgcattcagttccgtcatggactgtgactggatatttgcagcagaattcatttcacccgaaacattcttgctcgatcccgcctgtttttccagacggtcggagacatgtcccatctgccggatcatttccttcattgatgcaataaaatgttccacgctgcgccccatcacagcaatctcatcatttcctttcaccttcatggatacggtaaagtcaccggatgccatgctggtaattacccttgtcatctccttcaccggacgaatcaccacatgcgtcacacgttcgatcaaaacacacaatacaaggatcgaaataatgctgaaaatgatcataagattccgcaatcctaccagatccgcaagtacaacattcgtaggaacataggaaaccagcagccagttggttccatttacttccttaaataccgtcatatttccatcgagtgtacagaaatcatacgatttgccggaaacctttttctccacatctttataaaacgcactctgtccgtctgcccccagtgtcttggaaatcagatcggaatccctgcttgcaaggatcacgctgctgtccttgtccacaagaaatgcctctgcatcgtgcatttcgataaaagaatttacaatcacggaaatacggtccagtgtcatatcggctgcaattacacgcacggtatctgaaccatcattcaaaagtccggatgcactgacaacattcgttccgtccggattctgatgtgcagatccaaccgccatattcactcttgtcataccttcctgataccacatactttccttcggattcggttcctgctttttggagtctgtaccttttaaaaagctgccattggcatctgcaaggaaaagaccatccggataattttcactgtatccgcaggatgcatccaaaatggtctgcagctgcgcctcatccgggtgtaatttttcaatcatgttctttgccatctgcatggatgccagattttcctcaagccatgcctcaatttttgatgcctgactgtttaccgaagattccagtaaatttttggaataactctcgataattccggatgatacatgatatgcggtaaacaccagaatcagtataatcgcaattactaccggaataataattccaagtaattttgctttaatagaaatgttacccttctttttcacaaacgattccctccctcttttgtttctgtccctattatagtttcttatgcctgtatcgtcaatgttttgcactttttaaaatttttctgcttttttcggatacatgcacaaaatgagagagaccttacggtctctctcaaataagaagaaaaaattgaagtatgtaaaacaaaaatttgatattgtcaattataatatccggatactacttctgtacattaaatgctcccatacccggataaacagctgctgcaccaagttcttcctcgatgcggagtaactggttgtattttgccacacgctctgttctgctcggtgcaccggtcttgatctgacaggtatttaatgcgacagccagatctgcgattgtggtatcttctgtctctccggaacggtgagaagaaatggctgtgtatccggctttgtgtgccatcttgattgcctctaatgtctcagagacggaaccaatctggtttaacttaatcagaatggagtttccgcagccaaggctgattccctttgccagacgctcggtattggtaacgaaaaggtcatcaccgacaagctgtactttgtcccccagctcggcggtaagcttctgccatccttcccagtcctcttcatccagtgcatcctctatggaaatgatcggatatttctccacaagctttttccaatgctcaatcagctgctcggaagtatatacggttcctgcctttggcagtttgtactcgcccttctttcctgtcttccactcggaagaagcggcatccattgcaatcttaaagtccttccccggctcatatccggctttctttacagcctcaagaatggtctcgattgcttcctcatccgatttcagtgccggtgcaaaaccaccctcatccccaacggatgtggcaagtcctctgtcctttaaaatagaagccagtgcatggaatacttccgcacaccatctgagacattctttaaaggaaggtgctcctaccggcataatcataaattcctgtacatccagtccggaagacagtgcgtggcatccaccgtttacgatattcatcatcggaaccggaagacggttcccggaagttccgccaaggaaacggtaaagcggaatatccagtgaaattgctgccgctctggcacatgcgatggaaaccgcaagaattgcatttgctccgagtttggacttgtccttcgttccgtccgcatcgatcatggctttgtcaattgcataggtgtcagatgcatccatgccctgcagtgtcccattgatcacggtgttgatgttttcaacggctttctgcacgccctttccaaggtaacggctcttgtctccgtcgcgaagttctaaggcttcaaactcaccggtggatgcaccgcttggtgccatgcctcttccgattgtaccatctatcaatgtaacctctgcttccacagtggggtttcctctcgaatccaaaatttctcttccaactactttttcaatctccagataattcatcttttttgttctcctttcgatatgcgaagaactccttccggaagcggtaatggcgtcgtctgtacttccgttaaacacactcagcagttatgtgtttgcgaaggagtcttccaatgatttacacaaggaagttagttgtatctaacccaagaaagattatatctgacatattgaaaaatagcaagcattttttccgatagtttttatcaactaattttaattagttatatcatactgcatagcttatattttcatatcgtgcctgcattgtccttttctttttaaatctggcggatgagatttaccatctccacagcacccagtgcacaatcataccccttgtttccagctttcgttcccgcacgctcaattgcctgctcgatattttccgttgtaaccacaccaaacattaccggaatttcgctctccagggaaacggcagccacacccttggatacttcattgcagacatagtcgtagtggcttgtgcttccgcggatcacagctcccagacagatcacggcatcatactttttactcattgccatcttctttgcgatcaatgggatttcaaacgcccccggcacccatgctacggtaatatcttcttccttcacatcatgacgcagcagcccatccatggcaccgcccagcagtttattggtgataaattcgttgaaccgtgcgacgacgattcctaccttcatattgtttgctactaattttccttccaatgtactcataatgttcattctccttttcttcattttaaaagtttaatacatgtcccatacgattctgctttgtttttaagtaaaacaggtcatacggtgtggcctgcatctggatcggcacgcgctctgtgatggaaattccaaactctccgagctggtatactttgtcgggattgttggttaaaagccgcatgctgtgcacacccagatcctttaagatctgtgcgccgatgtaatattcgcgctcatccccggcaaatcctaaggcaagattggcatctaaagtgtccattccctgttcctgcagttcatatgcacgcagtttgttgatcagtccgataccgcggccttcctgccgcatgtaaagtaaaatccctcgtccctccttttcaatctgtgtcatggcagcggcaaactgctgtccacagtcgcaccgcagggagccaaaggtatctccggtgaggcactcggaatgtacacggcagagtacattttctccgtccccgatttctcctttgactaatgccacatgatgttcaccatttaaacggttcacataaccgtatgcccgaaactttccatacttcgtcggcatctttgtcacagccacacagtccaccagcttttcatggcatttgcggtattcctggagtgcggcaatggtaatcatttttataccgtgcctttttgcaagtgcaagcagttccgtcgtgcgcatcatggtgccatcctcgcgcatgatctcacagcagagcccacattcttttaagcctgccaggcggcacagatccacggttgcttccgtatgcccgtttctctccagcaccccgttcttctttgccagaagcggaaacatatgtcccggacgccggaaatcctccggttttgcatcctctgccacacagcgcatggcggtcatggaacgctcggcagcggaaatgcctgtagtcgttcccacataatccaccgaaacggtaaatgctgtctcatggttgtcggtattcgtttcgaccatctgcggaaaatgaagcttttttacatattctgcagacatcggcatacaaataagccctttggcatgcattgccataaaattgatattttctgttgtggcaaattccgcagcgcagataaaatcgccttcattttcacgatcttcatcatccgtgactaaaatcagttttccgtttcgtaattcctcaagtgcttcttcaaccgtcgcaaatccttccattattctttcctcctgttttctttgttataaccattcaaaatccatatttttcaagaaacgcctgggtgatgtgggtttcctttttttcttcctgtggatgaagcagtttttccacatattttccgatgatatcggtttccaaatttaccagctctccctcttttttgcttccaagcgttgtcacctctgccgtatgagggatcatcgacaccgaaaaatcatgcgcagttaccgcggcaacggtcagactaatgccatcgatggtaatggaacctttctccaccacataccgaaggacttccggcggcgcctccacccggatccatatggcattgtcatcctgcttgcgcccggctatctgtccggtcgcatccacatgtccggctacaatatgccctccaaagcgtccgtttgccgacattgcacgttccagattcacaggactttttcttttgcactgtgccagtgccgaccggtttaaagtttcatgcatgacatccgcagtaaatctttcgtggtcaaaggaagtgaccgtcagacagactccgtttaccgctatgctgtctccgatatgcacatcctcaagtatctttctggcgttaatcgtcaacaccgcagaatgtgcgccttttgcaatgttttcaatggttcccatctcctctatgattcctgtaaacatgataatggcctcccctctgtcgccgggtatccctctatcagccagtccgatcccaacgctgtaacttttgtccggcttaatgtcacggcctctgcaggttttaaaaatccctgcccctcaaccggggttttggctgttgccccgccaaacagcttaggcgccacatatgcctgcaccttctgtacaagcccagcttgcagagccgaccagtttaaagttccaccaccttcgagaatcacgctgtcaatctcctgttctccaagctgtcgcatcagatcccaaagatctacctgcccatctttttccggtgtgactaaaatctgacatcctgcctccacatatggcatatgcatggcttcctgccggttacagcttgctataatcgttggaacttcttttgcggtacgcacaatctgtgattctaatggcgtccgcaatgctgtatcacaaatgatacgcaccggatttgccccgttttctgttcccttaagccggcaggtcagcatcggatcatccgcaagtaccgttcccacaccaaccatgatggcacggtaacggtttctcatgcggtgtacatgtgcacgcgctgcctccccggttacccagcgtgatgcccctgtgtatgttgcgatcttcccatccagtgtcattgcatattttaaaatgacaaacggcagtttcgtctgcatgtaatggaaaaacacttcattttccgcatcacattccttttccagtacatgttcggtcacttccacaccatgctccctcaaaatccggatgccttttccatgtaccagagggtttggatccttcgatccaatcaccaccctgcggattcctgcggcaagcagagcatcggtacatggtggttgttttccatgatgacagcacggctctaaggtcacataaatcgtagccccttccggggattgtatacaattagccagtgcattccgttctgcatgtggctgtccgtagtgttcgtgatatccctctccgataatttttccatcttttacaatcacagcacctaccagaggattcggggatacctgtccttctcctttttgtgccagtgctattgctcggcgcatgtaatattcatctgtcattttttctcctttttcatcaggtgatatggctcctgtgatattgcttcgccataccacaaaagccccaagcaaatgctcagggcttctttttaccgtgttctgctgccggggatatattttcaaatccttttattcataggaaataaaaaatgctctggaaataaattccagagcaaacatttcaatatccaccacaaccatacacgggttcttgtgtttctatcctttatcttctttcatccagactgtactgtcggcttcggagtttcaccgaatcatgccttgcggctcgtgggctataccaccggtagggaattgcaccctgccctgaagatctttataaaattgtctatgtataagactataatctttctttccttttctgtcaagagaatttttctggctttctatactgcctccaccgtataatgggctttccagataccgcccggtgcaatcagatttccccactcccgatcttttaaatctccggtaaaatcagcactgtcacagcgtccataccatggctctacacatataaacggtacatctgctcccgccagtgaccagactccaaacaatggagcatccatcgtaacggtcagatagggatttccttccatgtcacaaagagagacttcatgcacattctgattttcaatcacaagggcatcatcatcaaacagatgatcggtaactgtcagataactatttttcaattcataatccacagtaccgtttccgaccagaccatccacaatcgttgtacttgtaagcggaccagctacatcaaagcggattttacaatttttcggacgattgaatgccggatgcccgccaatcgaaaacggaagttcttcctccgaaggattttccacctgccagagcacttccagcttattttcctcgatgtgatatccaatacgaagggtaaacgcataaggatattttgccatggtttcctcattggattttaatacaaaccagagcgtatcctccgtctgagaatccagcgtaaaatccatatcgcgggcaaatccgtgctgtcccatggtgtaagtctgtcctttggtacgaaactgtttgtcttttaccgctccaacaaacggaaacagtaccggtgaggtgcgtccccagaattttggatcagctttccacatatattcttttccggtatttttacggaccagagattttaattctgccccatgttcctccacttcgattgcaatgagttcattctcaagcttatgtcttgccatatgttccatctcctctgattctataaattacgcgttaccgcttcactttttctctccctgtccattttatcttatgctattttaccgaggtttgtcaatggactgaatttgcgaagaagtagcaacagatactaaatcttcaagtgcaagcactctaggttcctccggattactgtctctgtttacaatagtgttaatctgctttggtatatttttattcacaagctcagggaaaaccactctgacatacattcactcctttacacttttgctgatatactttttcagaattacagtttattctataatctcccaatacccatttttcggtgaaccatgacgaaccacaatatctgattctttcatttttttaatattattttcaacagtccgcctagatatatctattctgtctgctatttttttgaccgaaatatatttatcttctgctatacaatctagtattttctcctgagtctccgtcaatttctgtgctttttctctgatacggactttatctccgaaatcatttccaccatttactccaccatttactccaccatttactccaccatttactccactattttctccaccatttgcattatgctgcacattcctatataaattcacccgaaacatatcatcaaatacttccacagtcggaacaggcagtccatattctccagcaacacttataattcttctgatgccacttccccacgcttctaccagtcccatctgaccaaatatatttgcaatcagcttgtttctaatcttggaatgacctttcatcacttcctcgtaggttagtccattgtatagtccacctggagatgtcacttctaagcgatcatcataaattgccacctgtatgcaggattcatctaacaggtttctgtgacaatgtgcgttgattatcatttcacgaattgcttctactgggagttcatagctttcccgacgcactaagccatctattgtcactccaagtctgatatttctcaaaacaaaatcaaccgcactctctatctgcttgtatatcggtccagtatattcccgtttatcaagaaaaaccgttctatccgttcccttgaatacggcgcactgcgtctttgcaaacggaaaataatctgatgttagcagcacatacgcatttgatgcaagcacattgccttcgcttttcttcaaaattttccaattaaacaactgctcttttcttacatcatgccccgaaagtcctgccttctttcggaaatcttcaatatccttgcataaagactgcgttgcttcttccgtcacttcatatcctacacaagtaagctcatcccaagaaatacgggcgccttccatctccagctcacttatcttttcctgatgcgcatgtctggaagtaccagccacacgaatataggtgcctttcgccttaccttgggctttaatataatatggtcggttttttcctgcttccaccgtgataacaatgactgtcttgccatcaaccgtctgcggcccaatgtccggtatgatctgcggttcacaagaatctgatatagcatttgtcaaagcgtccatagcttgaaacaaactatcattgtcaacaccaactacctgatgtgttttatcatcaatacctatgaccagtctgccaccctgtgtattggcaaaagccacaactgttttcatatatttttcgcttttatccggtacaactaccttgtattcaatattctttgattcgccagaaaacagctcatcttttgccataatgctacctccaattttcttgttctaatctctactttcatcttatcaagcagattatccgctgcatccggtgccatcagatcctttgaaatataatgcactatatctccgcctttaattgattaaaagcctcatcaacagatacagcatcaattctttttgcctgtgcaagtccggtctgcatcatagtatcaaattcagcttgtgttatagaatctctcgtagcaagtttatccggaatatcaagtgaaaatggtactcgtgctgttacatttgcagtttttgttgccatagtatgcacctcctatttccgatagtgttccaccttgtatggctttttacaacacaaatattttttaaccagccatttaaatgaggagttttctcaccatctttgcatcaaaggtaacagttttcagatgatccacctcaatctgatacagcgcatttgcagcaatatgttctgccgcctgctccaaatcacggattccactggtacccgaatacagatccacgattgtatttaatgcctcatctgtgatgatacattcctgttcctttaagctcatgcgctttaataccttaggcaatgcaaattttgagaagataatcttcttttcctcaaacgtataatccgggatatcaattaccgcaaaacgcgacagaatcggtgcgctgatctgctccttatcgtttgctgtggcaatcggataaacaccggatgtcgggatcatacactcgatatagttatctgtaaatcccagattatccagaagtgtcagtaaaacatctgccggatttccgtttccttttccagaagctgccttatccagctcattgataataaataccaggcttgactctcctgccatggcaaatgcatccatgatgatccccggctttgcgttagcataaattctcgaacttccggtcagctgctccggatcattgatggaactcatatcaagagttgtccacggaagtttcaaaatacgggcaactgcataggcaatctgcgattttccggttcctgccggtcccaccagaagcagtccgtatgccggaagtgtatgtgtgcggttaatctgaatgatcgtctcaatgattctctgctttacacgctccatgccatacagttcctcatctaaaatccgacgggcttccttgggatcaatggcctcaaaataattgtttttccactggatattcatcataatggaaagtgcacgctgtgcatgacgccgctcttccggagacacttcattggaacgtgccactgctaaattccggcgtgcccacaaccggatgttatccggcatggtccgtcctgcgcaggtcataaaatcggtgatgctctgaatactggtgagcttcatatcatcgccgtcttcctcctgctcctcatccaccgcttcctcactcggtgcactgctggcaaacagacgctccatcataaactgtaaaaagccatcttccgcggaaagcttttttccaccgccaaatgcaatttcacggatcttatacacggcatatccatccggtgtgttctctccagacagccggacattaatgtggttttcccccagccagcgaagcagattggcaaaacgggcatccacccgcaaaatatccgcacatacagttccgtcttcctgggtaaactcaaatgctgtgcgctttgtctggttcgtgaacactccgcaggaatgatatttccactgctttgccgtattatctaaaaccagaatcggatattttgcacttgcagtgttttcattcgactgaaatgttgtataggtacactcacaggctttcttttcttccgttgtattgctgaaatcaaatacaggcatatctatctcccttctacatgatttaagggtcaaaaacagttttgacccttatcatgcataaacaattctgttattttctacgaaagcagtgctttatcacttgcaaattcctcaccgcttactttttcaaactgatgcagcagatctccgaccgtaagtttctttttgtcttcacctgcgatatttaaaataacttttccttcatgcatcataatcagacggtttccatgggcaatcgcatccttcatattgtgtgttaccatcatggccgtcagatgattctctgaaatgatctgatccgaaatctcaagtacctttgcggcagtctttggatccagcgcagccgtatgctcatcgagaagcagaagcttcggtttctggatggaagccatcagaagcgtgattgcctgacgctgtccaccggataacagaccgacttttgatgtcaggcgatcttccagtccaagatgcagggtggaaagcatttggcggtatttctcgcgttccgctttggtaattccccatcgcaatcccctggattttccacgtcttgctgcaattgccatattttcctcaatggacattgtggtagccgtaccggtcatcgggtcctggaacacacgtcccagatattgtgccctgcgatgctcggataactttgtcacatcctcgccgccgatatagatttttccggaatctgccggccatacaccggctacggcattcagtgttgtcgattttcctgcaccgtttccaccgatcactgtgacaaattcgccttcctcaagtgtcaggttgacaccgtccagagccactttttcatttatcgtacccggattgaatactttccggatattttcaatttttaacatctcactcatcggttacagcccccttgttgcttttttcttattcttcagatatggaatcgcaaggaaaattgctaccacgattgctgagaacagtttcagatcatccgatgggaatttcagccacaaaatgatgctcagcacaaggtagtaaatgatcgctccaacgatcacggaaaacagcgtatatgcaaatgccagtttctttcctgcacacagttttccaaacagtacatctccgataataacggcagccagaccgataacgattgcgcctcgtcccatattgacatccgctgcaccctgatactgtgcataaagtgcaccggacagaccaacgagtccgttggaaatcatcagtgccagtaccttacagaagctggtattgattccctgtgcacgcgccatctgcgggttacatccggttgcccggatggcatgcccctgctcggttccgaaataccagtaaagaatcgccacgatcactaccccaaacaggatacaggtggtaaatactttaatttttgctgctgtatcaccggatacataacgaagcgataccgcaagggaatatttatccacactgatcgcctgattggactgtcccataatattcagattgatggagtacagtgcaatctgcgttaaaattccggcaagaattggaggaattcccagtttggtgtgcagaagacctgtgaccattcccgcaagcattcctgcagcaaatgcaaaaataagggaaacccacggattcatatcactgcggatcagcataaccgccacagctccgccggttgcaaaagaaccgtccaccgacagatccgcaaaatccagaagtttgtatgtaatatatactcccaatgccagaaggccccagatcagaccctgtgcaatggagcccggcagcgcacgaaacagcgccagcggacttaaggaagcaaaataagcagatattaacacgatacccatcccccttaattattcagcctcgatagccttgtaatcatccggaattttaacgcccagctgatcacagatatctttgttgtattctttggttacgttcggtgcagtctcaatcttcatggttgtaatatccgcaccgtttactaaaatgtcatatgccatttcaccggccttttttccgatgtcataataactgatggaaagcgttgccactccgcatcctttacagataccttcctctccggcaataatcggagttcctgccggaagtgcgatattgttgattgcttctgtgttctgtgccatggtattgtctgtcggaatgtaaataacatctgcatactcggttgcactctgtaccacagaaccgatatcattggaatcggaagcggtaaactctttgtagctgataccgtcctcatccaggtatttttcaaactcggttgcctgatatttggagtttgcctctgcagagcagtaaagtattgcgacatgctttgcatccggatagagctctacgagcatatcctcctgctgatcaagcggagccagatcggatgtaccggagatatttcttccggttgtaccactccagtcactgatctccaaagccgttgcataatcggtaacggaagttcccagaatcggaatatcggttgtcgctgctgcacatgcctgtaaagcagtggttgcatttgcaagaatcagatccacattggcagatacgaaattatttgcaattgtagaagcatttgcctgctcgttctgtgcattctggagatcaaattttacattgtctcccagcttttcctttaagacatcctcaaatccctgtgttgcctgatccagtgccggatgctccagctgctggcagattccgatgttatatactttaccggatgcacctgcactctgtgtcccgtcttttgctgcatctgcggaatttccacaggcgcccagggataccaccatggctgctgccacagcaaccgacattgccttgtttaattttttcatagttgttcctccatttatattttatatagtcagatagactttaagccgcttcccgtcctactggaaagcggcttgtccactgcgtaattacaggaaaatatatttgcagataaaaagtactgcaaggatatacatcagtggagtaatcttcttacgcttgccacagatcagattgatcagtacaaaagagattacaccaatggcaataccctctgcgatactgtacattaaaggcatcgcaatgaggcacagatatgcaggaactgcatctgtcagatcctcgaaatcaacctttacaattgcggataccatcaggaatccgacaaagatcagcgccggtgctgttgcaaagcccggaattgccgtaaagattggtgcaaagaaaattgcaagcaggaataataatcctgtaacgatggatgcaagaccggttcttgcaccagctccgacaccggcagagctctctacgaatgttgtagttgtagacgtaccaaggaccgcacctgcagaagtagcaattgcatctgccatcagtgcctgctttacgttcggaagttttccatcttcgtctaacatgccggccttatccgatacaccgatcagtgttccgatcgtatcaaacatatctacaaacaggaaagacaacatgactacgatgaagttcataattccgactccatggaaatctgctgtaaaacactgtccgaacgtctccccgatttttgaaaaatcagtcatggcaaatgtcggatacagagaataaaatccagcgtctgcatcgatacggtaaacacccgctgcctgacagatcattccaagaatccaggtagccagaataccgatcagaatagatcccttgacttttttgatgtataaaattgcagtaagaagcagaccgatcagtgcaagtactgcacagattccttcggtatgccagttatctctgaaatttacataagataacaatgtggaatcgttgtttacaacgatatgtccaccctgcaatccgataaacgcgataaacagaccaatgccggcgctcacacctttctttaatgtggtcggaatggcattgaaaattgcctcacgcacattggtaagagaaaggataataaagataataccttcgaagaatactgccatcagggctactttccaggaatatcccatatttccgcatacggtaaatgcaaagtatgcattcagtcccatacccggtgcaagtgcaaacggataatttgcaaggagtgccattgcaaacgtaccgataaaggatgccagacaggttgcgatcagcactgctgtcgggtccattcctgcctgtgaaagcaggttcgggtttacagccaggatatacgccatggtcataaacgtcgtaataccggcgatcacttctgttttcgctgtggtattattctctttgagcttaaacattttctctaacatgttctctcctccatattttattgttgtgtaaaagcaccctactattttatcataaaataattgagaaatccattcaattatttatgtctccaggtacttcttgaaaagagaacaagcatcgggaaaatttccagtcttccggccagcatgtcaaaaatcagcacaagtttggaaaaccaggaatacaccgaaaaattacaggtaggtcccaccacatcaaatcccggtccgatattgttaaagcacgcagcaaccgcagacacatttgttgtcatggacagtccatcaatagaaatcaaaagaaaacttccgactaaaatcacaccgtaagccgccagataggtatttgtattatttaatacatcctccccgatccggtttccattcatgcgcacaacttccacacgctgcgggcttaaaattctgcggatatttctgcgcaggtttttcagaatcagaagaagtcttcccatcttaagccctcctgccgtactgcctgcacaggcaccgacaaacatcaggcacagcaacagtgctttcgaaaatccgggccacaaatcaaagtccgtgcttgcaaacccggtcgtcgtcatgatagaggaaacctgaaatgccgcatggcggatcgtctcttcccaggagccgtacagtccccggatattgaacgtaattaaaagaatactgaccacaaatatgatgatatacagccgcagttcctgatctttgagcacttcctttacatgccggactaaaagcagataataacagctgaagttgattccaaacaaaaacatgaagaccgtacatacattctgtatatatgggctgtatcctgcaatactgtcattccggattccgaatccacctgtgccggccgttccaaaagcggtacatacggcatcaaaaaccggcatttttcccaacaggagaaacaggaaattgatgaatgtcagcaccatgtatatgacgtacaaaattcttgctgttgtacgcattttcggcaccagcttgttcacattcggtcccggactctccgcacgcagcagatgcatggtataccctttgcctctctctccgttcggagaaagtgccagaagaaatacaagtacccccatgccgcccagccagtggctgaaactccgccagtacataattccgggagaaagtgcttccacatctcccaaaatcgaagaacctgtggttgtaaatcccgatacaatttcaaacagagcatcgacaaagtttggaatttccctggaaaaaacaaatggcagacacccgaaaaaactgattgcaatccagcttccggctacgcagaccatcccttccctcgcaaaaaaacgacgggtggaatttctgcaaaaataatacattaaggcaccaactccggcagtgatcaaaatggacagcccaaacccataaactgctgccaggcttgcggtatacagactgatcaaaagtgccggaaccataaaccctgcttccacaattaagatctgggaaagaaattttcccatcattttataattcatagcatcctcactcgaaaatatcattcagctgcaaaagtgtcatcccgccctttgcaacgataatcacggaatttccagcctcatacatggaatctccgtttggaatctccgttttacttccatggctgatacatgcgatcagtatattgcgtttcaggcggatattacgcaatggttccccgatatgttttgtgtcggcatctacgacaaactccaatgcctctgcctgtccttctgcaatattgtgcagtgtcagtgctgcacctgttgtattctgcatggcacggacataacggacaatcgtattgcagcagagttctttcgggcagatcacactgccaagtcccagactgtcctgcatactgttattttccatatgaccgactttcgtgatcacctgtggcactccacaggtctgcgcatacagcgaaataatcatattcatttcatccatgccggtcatggttacaacggcgtcacaatcatggatgccttcactttcaagcagaaactgactgctggcatccccgtgtatgatacatacttccggtggaagtttgccggataattcttcacagcgcgcttcatcctgctcaatcagcagcacactgacaccttcttttgccagccaggtcgacagataataaccgattcttccgccaccgcagataattacacgctttgccttgtgcgtgataatgccaagattgcgcagaagctgtgtcagcatctcagcagttgccgtaataaacagatgatccccctcccggagaataaaatgtccggatggaatctccacaacccctccgcggctcactgcgcagacaagcaccttgcatttgacaacattttccagattcatcagtgccacatcgcagagtttacttcctttttgaatccgcagctccacgatttccacacggctttttgcaaatgtttccctctgcaggaagcccggatagcggatcagccgttcaatctcgcgcgccgcctgtttttccggattcaccataagcgaaagggaatagacatcccgcatggtaaaaatctgcttgccgtattcgggattacggattcttgcaatggtgtgaattctcggattcagaccatgggcagtcataccacagagcagattgacttcatccgaactggtggctgcaatgagcagatccgcctttttcacatccgcactctccaacacgcgcatggaggcacagtttccctgtacccccataacatcgtaacgctccacactcgaatccagcacacgctggttcgaatcgatcaaagtcaggtcgtgtcctgccgcagcaagtttctgcgtcagcgtgagtccgaccttgccatcaccggcgattattattttcacagatttgtcctccgtttatattctgtatttagacgtcccacattatagcatatggcatatagaaatacaaccgaggagtttttggtctttactgcttcttatcctcctgatattcctcaaaactgagaattactttaaacagatcgccgtccatctgcaccgcaagatttccatgcatcagctcggtcaggctttttgcgatagaaagccccagtccgtgtccttccgtattccgggaactgtctccacggacaaatcttccgaaaagttcctcgctggtcattttcagtcgatccttcgaaatattgcggaaggtcataatcaccattccgtgaaatttttccaacgtaatatacacacgtgttcccggctgtgcatacttacatatatttcccatcaggttgtcaatgatccgccacaaatgtctgccatccacatagatttcaacgggtggttgcggacattctacaaccatctccagctgatttgcctctgccttttctgaaaattccccgacaatctgtgtcagaacgaccgttgcatcacatacttccggattcaccggaagatttccagtagatgctttggatgcctccatcagatcctcaatcagttttttcagacggttggactgtcggtcaagcacctcaatgtactcccgcattgtttcactctctgtcggctcctttttgatcagatccacatagttgataatggaagtaagcggtgttttaatatcatgggagacattggtgatcagttcggtacgaaaccgctcactcttcattttttcttctaccgccgctgcaactccggtctgtacattatttaaattttccgcatgtgtgcgcagctcatacatcattttttctgtatggatcggatgcgaataatcaccttttgcaatccgttcccctccgtcgaatatctgtcgaaactgcaccacaatctttaacagtacgccgtattccacaactttccagaggagatagaccatgataattccgccatccgctccggcacacagtaaaagaaatgcttctatgaggaagaccacaagaaatacagctgtgacttttaccgtcatagacagattggtcaaaagcgccagtctgatttcatgcagttctctttttatccggcgaaacgggtttaaaagcagacgcaaaagcgtataatgccagaattttcctgcacggattcttacaatgatactgatcacatattcatacacaatcagttctgccaatgcaaacgcaattgtaaaaaatgaaatacagaatacgattcctgcattttgcataagcagatctcccatataaaggcataccataccgcagcccaaaaacgcaagtcctgagattcctgtataaataccaaatggtatacggtcaatccatcgaatctgtaccgtatcagaaccacgtttccatcctgccgatgcaaatagaatgccaagagaaaacacccacacaagaacactcaaaagcaaccacaatcccgaaatttcccgcacctgtaccacaacgcctgcaagtgtgtgtgctttctggaaaaactgtgttttcccggaatcaatcacaatatgggtttcacctccgacttccggtgaaaacaaagaggataccgtagcagtgcttcccttcagggaatccgctaccgtaagataaagcgtatattccgttgcttctttctcctgatgtggattataataaatacgaccctgttgatcttcgtatgcaaatgaaaaatcctgccactggaatacctttgctttcgcataggtatccgcaatggattcctgccggatcgggtaaatcccatccttttttgaccataagtaacctgcctctaacccatcaaaatcaaaccgcagctcggatgattttaaatacggttcgagcttaccttttttcagctgttctccattttccgcgcaatatctgccaccatcgtccgattcccggtaagtatattccacatacggttcaagatccgactcctctggaaccgcgtaaaaagaaaaggaattgatccgaaacagggtatcgcccgcataacaataaatcacaccattatcatagataaaatgatccacctgcgtataatgcttgactttttgcatgtactgtcccctgtttcttccaagcagcatatcccagaaagaacgatcattggtatgaaactcattttcatctgtaaatttcagccaggcaagtgcgttttccttatttaaagaggtacccgtgtaatttccacagacaagttcggtttctttttcattcggcttgttttttacaagtgaataaacgatatttccgtcatcaaattttttcagggcatctgcttcgtcctgttcttttgaaatgccggtaaccgcatcccccatccagtacgcatagcttctaagcagctccgtatccagtattttttcaatgtctttctgtgagccctgccaatcactgttcatgcctaatgtaactgtcaccacactggtcacggccacaaaaaatccgcttacaatcgcaagtaccatagccagtaatctgatgccctgcgatgatttccagtttttggaaacatgttccggcttttgggattttttatcctttttctcattcattttctacatcctccatcttgtatccccgtccccacacgacttttaaatagcgtggctccgcaggattatattcgagtttttcccgaaggtgccggatatgtacggctaccgtgttttcgacgccgcacgggctgcccttccacacggcctcataaatctgtttcggtgaatatacttcccccggatgttccatcagaagttttaaaatatcgtactctgttctggtcagattcacaggttctccgtccagagtgacttcctttaatttatcatccagctcgatgccgccggcggacagttttgtcctcaccttctgtccgcttccaagcagcatataccgccggatctgggatttcactctcgcctgcagttccaccggattgaatggtttcgtcacataatcatccgcgcccacggtaagtccgagtaccttatcggtatcctcacttttggccgtcagtaagatcaccggaacattggaaatttcacggattttgcacatcgcttctatcccgtccatttccggcatcataatatccatcagaaccagctggatatcctcccggtttataatttttaaggcttcctttccgttataagccgaaaacacctggtatccttcactttttaaataaatctgcaaagcagaaacaatatccttttcatcgtcacaaactaaaacattatacataaaaaaaccgccacctcgtattcatgattaatcatagatacattgtagcggtttttttcttaatttccaatggggcaaacctttaaggtttgcttaaaatcaggaattattcttattttgatatcttttcttctttcagccatgcatcaacgctctcatacagacgctgcattccatcttcaacaaccagcttggaggtagccacattcacgcgcaaaaatccttcgcctcccctgccatactgattgcctccgctgacatacagaccgctggttttgcggataaattttacaaactgccggccactctccgtgattttgcggcagtccagccacatgaggtaagtagcatctcctgcaaccggatggatgagtggaattttctcctgcagaaattccgtcacatactgcttgttcttttccacatattcccgcagttcatcaagccattcttccccatattggaaagcggcaatcgttgcctgaattgcaaaagcgttcggttctgctacttcgtcggtgttgagctgtctccacattctgtgatgcagaatcgagttttctgcatagacggcagccgtctgcagccctgccagattaaatgtcttcgtcggcgcaatgcaggtaacactaatgtccctgcaggtatcatccacagaggcaaacggaatgtattctgtaccgggttttgtcagatcacagtgaatttcatccgagacaacaatgacatcatactgcttacataatgccccgatccgcgccagcgtctcacgatcccagatgtttcctgccggattctgcggattacacaaaatcataagcgtcgtctgcggatctgccagctgctgttcaagtttttcccagtctacacgatattcttttccatcataaagcagttcattttccacgacatttcttccgttattacgaatggaattgaagaaattattatagacaggtgtctgaatcagcacattttctgccggagtcgtcagttttcggacagcagaagaaagtgcagggattactcccgttgtaaagatcagcttctttgggtccatccgaaaatgatgacgcttttcccaccagtttacatagctgtccgcccattcgtccgggatgacagaatatccatataccccgtgcgccacgcgctgtaccagtgcctcctgcacttccggcaccgtctcaaaatccatatccgccacccacatcgggagctctttgcgatccacatcccacttgagggaatttgtgcctctgcggtttggtattttatcaaaattatatttcataatcatcaggtctcctttttctgtctctctataatgccttatcataccacttctgcatcatttcttcaatcattgcagtaccatcagaaacggaaaaagaagggaaaaaatacctctttttccggtattttttcccttcttttgtaaacaatcaccgggctgcagcagtctgttttcagccttcggtctttgttgtgctctctttggacttataataatcctcaaacttctgatttgcagcatccagtgtcttctggcagatgtccggaaggtctttgccccatgcaccggttgcctgcttgaatcctttctgcatggcagtctgcatcttcttcatcttttccacatcatctccggcaagggcacttgcaaaatcaaataatctctctgatgtctgctttactccgtaatagccatcttcggagatatccttctgcgcctgtgcctttgttgctgcatcaaccgtgaaatccccttttgcaaggaacttccatatatcatcgctgtttgttccgtttgcaacagaagaagtagctgcctgaccggtcatcattttctgcacgatgctgatcagctgctgctgtctggactgtgtatccgctttcatctgctgtacgagtgctgcacgatcctcagcgctcatcttattaatcgaataggttgctttcttattgtccttgctgctgtctgatttatcatagactacaccgctctcatttttttcttccgtctttgccgtggagtccttctttgcagccgtctcatttttggtcaccgcatcgtttttataggatgcgtatacctctgtctgcgtgtttaacaaacctgttgtgtttacacccatactctcatcctccttgaattctaccggtcaattccatttgtttccggttaaactatgttggtatctactatagatatcggttcttttcacagaatctttatagtttgctttatttttgtttcacagtgacacgataggtctttccaacggcagattttgttctggccttcaccatcacatagagtttctgcccctttgcagcttttacggtaaacttctgtccggtctgtgcataatcttcctgtttgaccagcttctttttctgattatatacacacacattccagtatccgctgtcaggaaggcttacttgtatggtcacctttcccttctttgcagccttatatacaaaataatctttatcctttaccgcataattattcgcactacaggtcttattcttttttacagttgtagctgtggcaaaagaatcattggattcctgttcccagttatcagccttgtactgattgactgtcaccgtgtattcgtgtccgcacgcataatcattgatattccgttctaccttcaggtaaatctctttgcctttccggaaaccgagctttgcagtggaaatctgcagatcatcctctgtttccacggtctgaagcagcttctttttctcatcatatacggaaagtttccagtactgattgtttccaccgtccgcatttgtaaatttgaaattgaaatatccactgcccgtggcaacgtagcggtagtaatccacatcttttttgctgttgatacttccatgcagtgtctttccggcggtaagatccgtggcaagtgccatgatatcgttggattccttttcccagccttccgttgcatagtaattggaacggatcttgtactggtttccaacgccgtagcaggtgactttcacatacacttttgctcccaccggaaggacatatttattggaggatacggttcttgtattggtatctttctgcagttcattcatattttcatcatacagatacagattccaaagagcggaagatccctccccctgaaaatcatatgtgaaatatccatttgccggaatgctatacacataccagtccacatccaaagctttgtaggaacttccattgatccaggtgccgttctgcagacttgtcgctgccgccggtgtatcgttgtcttcctgttcccactgtgcactctccgttgttttcacctgaagggaatactgataatcctgtgtcagctgataatctaaaatggtaatatccgtagatttcacatgctcaactttgatatatacgcttttgcccggtctgaggttataaattctggatgtataattggatgccagaggttttgtttccagttcctgatttccattgtccgcatcatatatggaaaaattccactttccttttccgcttgtctgtgcaagatttacagtaaaatatccggctttttccgcagtatacttataaaagtgaacattattggaagtagacagcgtatcatacaccaccgtatctgacttcagcacctctgctttggtgtagctgctgtatgtgccggtcggtgtctgattggtggaaatggatactttgtccgcttttaccgccaccggcgccgctgtaaaaacacagcagcatgccagcagcaatgccagacctctttttttcatgttatgattcatacgcatattccctcttttacagagctttgatacgctccagtgcctttacggtgttttcataatttccaaatgcagtcagtcggaaatatccttctccgcttggtccaaaaccggatcccggagtaccaacaacatttgcattctccagcagataatcaaagaactcccaggaagtcatctgatccggagtctttaaccagatgtatggtgcatttacaccaccaaatacggtatatccggcatcctttaatccttccttaattgtctttgcattcttcatatagtaagcaacctgctcctttaactgtgcttttccttcctcagaatatacagcctcaccggcacgctgcacaatgtacggagcaccgttgaatttggttccgtgacgtcttgcccacatgtcgtgcaaagaaacttccccgcactttaaatccttcggaactacggtatatccaagacgaacaccggtaaatcctgcattctttgagaaactgtgcagctcaatggcgcaggttcttgcacccttgcactcataaatggaatgtgccacattgtcctcactgatataagcttcataagcggcatcataaatgattacggcgccaactttattggcatagtccacccattcctgcaactgatcctttgtaagcgttgttccggtcgggttattcggcagacacagatagattatgtccggtgtcttcttaggaaactccggtacgaaatgattttctgctgtacatggcatgtaaatgacatcgctccatgtgccggtctccttgtcgtaagtaccggttcttccagccataacgttggaatccacataaaccgggtataccggatcacagaccgcaatcttgttgtcctgtccgaaaatctcctgaatatttccggaatcgctctttgctccgtcagatacaaagatttcatctgctgcaacctcacagcctcttgctgcataatcgttctctgcgattgccttgcgcaaaaattcatatcccagatccggtgcatagccatggaatgtctcggcatgtcccatctcatctaccgctttatgcatagcctcaatgattgcaggagccagtggctgtgtaacatcaccgattcccagacggataatgttcttgtccggatttgcctcctgatatgcatttactttttttgcaattgtgctgaataaatagctgcccggcagcttctgataattctcatttacatgaaacataatttcgttctccttctctaattttccatcagtatcactttaacattttcttcttttaatgtaaagaccagccaaaaaagccagataagatccctacccttcctgcagaagacttaagatcatctgtgccacctcgaccagaccggttccgttgtccatacttcttttctgaatatatttatgtgcttcctcttccgtaaaagagtttcgtgccataaggagttcctttgccttgcgaatgatctgctgatcctcctgcgaacggtgtttcggctgccgccgcattctccttctgcgcctctggatatctccctccatcatttcaattgtctgcaacagttcatgcactttcatcggcatggaaagacagaccagattgcttacctctctctcctgaatggaagacggagaagcgatcagaagcatctgaaactccggtggcagataatcgtgaatttccatatacatcatatccataaaccggcatccgcagatcagtattccacactccagattgtttacgcttgccagtgcctgcgcaccggtagtacagactgcctgcacggaatacccgctctgtgtcaatattttttttatgcccactgccacttccggtttcgaaaaggcaattacaatgttactcacgatccgatctcccgttaaatcttatacagatactcttcgatctcccagccggttacctgtgtacggtactgcatccattctacctcttttgcctcgatcagtttgctgctgatatgttctccaagcacttcttttataaaagcatctttctgcaattcacagatggccgcatgaagatcggccggaagcgactcgattcctctgcttgctttttcttcctccttcagttcatagacattttccggcacttcttccggtggctcaattttatttctgataccgtcaattccggctgcaagacataccgcaagggccagatacggattggctgccgggtccgggctgcgcagttccacacgggtttcctctccccgggaagcaggaatacggatgagcgggctgcggtttgtcgcagaccatgcaatataacatggtgcctcatatccaggtaccagccgcttataggaatttaccagcggattcatgataagagtcacacctttcatgtgcttcatgataccgccaataaaataataggcttctttactcaggcccatttttccatccggatcgcggaaaatattatgtccgtctttggacagggacatattgatatgcattccggaaccattaatcccgtatttcggcttcggcataaagcttgcaaacagaccgtgccgcttggcaattgtcttaaccgccagtttgaatgtcatgatattatctgccgtctgcagtgcctcatcatacttaaagtcaatctcatgctgtgcgggtgctacctcatggtgggaagcttcgatctcataccccatatcttcaagtgtcagcaccatatcacgtctggcattttctcccaggtctaccggaccgagatcaaaatatccggctttttcgtgggaaagtgttgtcggctggccattctcatcctgatggaacaggaaaaactcgcactccggtcccacattaaatgtatatccaaggttttttgcttcctcaatctgacgctttaagatataacgagaatcccccgtaaacggagttttgtctgcacagtaaatatcacagataatacgtgctacttttccctgctgcgggcgccatgggaaaatggtaaatgtgtccagatccggatacagatacatgtctgactcctcaatccgtacaaatccctcaatggaagaaccgtcaaacatacacttgttattcaatgctttctccagctgactggatgtaattgctacattctttaatgtaccgaaaatatccgtaaactgcagacggatgaattccacatcctcttcttccacaattttgaaaatatcttccttggtatatttgctcatatacttttctccttttctgcgttacatttgctgatatatgttaatacctgttcataagacatcggaccgccaaacagatccagcgcacttccaatggtgacgttcagccggtttctcccaagccttgaaagttcttccagatctttaaaactgtgaacgcctccggcataggtgatcggaatttttccccagtctcccagaaactgtgccaggggtttttcaattccaccggattttccttccacatccacagcatgcaccagaaactcgctgcaccaggaactcagtttttccagaagttcattcgtcacacgctcggtggtaaatttctgccaccggtcggttacaatataatagcccggttcttctgcatctgcccggtatctgcacgacagatcaagtaccagatgttcctttcccacggcctgttccagccggttcagacaatcatagtcaatccgtccgtcccggaaaacaaacgaagtcacaatcactgccgatgcgccagcttccagaaattcggacgcattggcatcggtaattcctccgccgacctgcaatccccccggataggcacgcagagccgccagcgcctgatttttggtttcctcataataagggctgtcttttgcattcagtaaaatgatatgtccgccacagattccccggctctgatacatccgtgcataaaacggtgcatcctgcccggagacaaaattttcacttgcctgatctccggcatcccgcagactgcttccgacaatctgttttacctttccgttgtgaatatcaatacatggtctgaattccatccgattttgtcctcttttcaaaaaatgggcatagaaagaccctgctgaggcccccttgcccttattgttgtatatcttcactgtttatgctgtttctccgctatcataacataatttttacttgacagcaatccattattttgctatcatcattaaaatcgttattgtacataataggtgttttggacgataacagacgttacacaaaattacatacaaactacatataatagaagaaagcgaggattttagaaaatgggaactattatcggcgaaggaattacatttgatgacgttcttctggttcctcagtattctgaggttaccccaaacatgatcgatctgaagacacatctgacaaagaagatcgtactgaacattcctatgatgagtgcagccatggataccgttacggagtcaaaaatggcgattgcaatggcaagacagggtggtatcggaatcattcataaaaacatgtccattgaagcacaggcagatgaggtcgataaggtaaagcgttcagaaaacggtgttatcacagacccatttttcttatctccagacaatacattacaggatgctgacaacctgatggcaaagttccgtatctccggtgttccgatcacagagaacggtcgtctggtcggcatcatcacgaaccgtgacttaaagttcgaaaccgatttcacaaagaaaatcagtgaatctatgacctccgaaggtctgatcaccgctccggaaggaattaccttagaagaagccaaaaagattcttgcaaaagccagaaaagaaaaacttccgattgttgacaaggatttcaacttaaaaggtctgatcaccatcaaagatattgaaaaacagatcaagtatccgctttctgcaaaggatgatcagggacgtcttctctgcggtgccggtgtcggtatcaccggaaacatgatggagcgtgtcgatgccctggttgctgcccatgtcgatgtcatcgttgtcgattccgcacacggtcattccaaaaacattctggaagccgtaaagaagatcaaggcaaaatacccggatctgcaggttatcgccggaaacattgcaaccggtgctgctgcacaggcactgattgatgccggagctgatgcagttaaagttggtatcggacctggttctatctgtaccacacgtatcgttgccggtatcggtgttccacagatctccgcaatcatggactgctatgaagttgcaaaacagagcggcatccctgtcatcgccgatggtggtatcaaatactccggcgatatgacaaaggctatcgcagccggtgcaaacgtatgtatgatgggttccatgtttgcaggatgtgacgaagcacctggtacatttgagctcttccagggaagaaaatacaaagtataccgtggtatgggttccatcgctgccatggaaaacggaagcaaagaccgttacttccaggaaggtgcaaagaaacttgttccggaaggcgtagaaggccgtgttgcttacaagggaacacttgaagataccgtcttccagctgatcggtggtatccgttccggtatgggttactgcggatgtcctaccattgaggatctcaaggaaagaggtaaatttgtcaagatttccgctgcttccctgcgtgagagccatccacacgatattcatattacaaaagaagctccaaactacagtaccgatgacaataaataaatcataataaatataatttgaggtgaattttattgggccccagtgagacaggtcaattaattacagtgattatcctgctgtgtctgtcggcgtttttttcgtcgtcagagacagctcttacaaccgtaaaccagattcgtatgcgtacccttgcagacaatggcgataaacgcgctgcacgggtattgcgtgtaaccggaaatccgggaaaaatgttatctgccattctgatcggaaacaacattgtgaacctttcggcatcttccatttcaacctcccttgccatccatctttttggaaacacgggtgcgggaattgccacaggtattcttacgtttttaatactgatctttggtgaagtaacaccaaaaaccatggcaaccatcaaagccgattctatgtctttgacagcggctgctccgattggatttctgatgaaaatacttactcctgttatttttatcatcaacaagctctctctcggactgatgtttctgctgcatgtcaatatcaaagatgcacagaaaaagatgacagaagaagaactccgcactatcgtggacgtaagtcaggaaaatggtgtcatcgaacatgaagaacgggatatgattcataatctctttgatttcggtgatgcagaagccaaggagatcatggttccgcgaattgacatgacttttgttcaggcagatgccacctatcaggaagtacttgatatcttccgtcaggatatgtttacacgccttcctgtttatgaagactcgaccgacaatgtaatcggaatcatcaacatgaaagacttcctgttacagaatgataccccggaattttccgtacgaaaccttctgcgggagccatattttacatatgagcacaaaaatactgcagatctgtttctggaaatgcgtaaatcctccatttctcttgcgattgtgctggacgaatacggagtaaccgcaggactcattactttagaagacctgttggaagaaattgtaggggaaatccgtgatgaatatgatgccgatgaagaagacgatatcacccggatcagtgatcgcgaattctatgtacttggttctgccaatctcaacgatgtcagtgaagcgctttccctgcactttacttcggatgattatgacaccataggaggatattgtcttggtcttctcgatcatctgccggaaaaaaatgaaattattttaacagataataatattcttctccgtattgaccggatggaaaaaaacagaatcgaacggatttacatccggcttccggaacctctggaggaaaccggttccgaacaaaaatccgaagaataatccgtaaattctgagggctgctttgcagccctcatttttatgccagtaactgccgaagccacacacgaagagaatcctccatgatccatttcgaatctccggcaagccctcccctttcttttggaatcagattctgtccggcatcctcaaaatattttttgctgataaaccggcagtgaaacgaaataatctttcccctcggaaaatcttcatccggatctttcggttttaccggatcgggatctccagaatccggtttcggatcttccctgtcagtccccggagtttccggatcagggtctgttggatcaggtcctgccggatcaggtcctgccggatcagggtctgtcgggtcagggtctgtcagatcatctgtgttctccgtcttccacactccataaagatcaattttcggactgtatctgattatccagctgtcctttaccactgccccacattttaagtctgccttttttgcatccggcttcattgcccatccaaccagtttttttcctttcgttttccacccgatattttccaaaggcacttttccataaccatacgtcattgtctgcacatccatttccgtatcatcttttgaactgttccggtgaaagaaaatctgcagtttctttttctgtccataggccacacaccgcacatcatttgtcacataaaattcctgtctctctctatccccataacaatctcctctccattctgcaaaatcatatcctttctttgcttttgcttttaaacatgccgtgtatccataacaatactctccaccaccggaaaccgatgcaatcccttcccctgcaatcgcatccacccagaaaaacaatccctgaatttctttgtggaaataattgtgaaaggaagtgtatgactctctgctccagctttccgcaccggaaattccctgataagtcgtatatacttttccagaaaccggtccctgatcattcatggttccctgcgcttttcctttccttaccacaatcatacaggcatccatcaccatagacgctttgcctttatttaatgcctgacttgcctttgcattcaaccggtccttcaggtctcccagtgtcagcgcatacagattatattctgcaccaccttttctgacacgatgcaccgcatacatatagtttccgccaagtttaaaatacatcgtctgcagttttttcccggaagaatcctttaccgacaacttccatccgattgtccggtagcggatatccgaacttgccagatttgctttggttgcataatagatcatcccatcggtttccgagaacgggaaaaagcatacattatttccatactcctgataataaccgtatgcattttctgatattccagcataaatgtctgtctgtctgaacggaagaaatgtcaccagcaatgccacgaccatcccgaacaccacaatttttatctttttttccattaaccgattgccacctcccagtattcacataataaccttccgttttcatcctgctgtcccccggtatataccccgataaactgatatatcttctctctttttgcaagtgtttttgtataatccggaagttccttttccgacggaaatacacacaccgctttctcaagcatggtgattttcctgaccggacagtccttcttttgtaaaaactcttttatcagcctgtccaattcctttcccccgagctttcccttggtccacttacgcatcagaacatccatttcctttttgatgttacagtcagtcacacttccattgctctgataatacagccattgcggtgtcagcaggtcggtctcctgcctctggcttcctgccatgatgcccggatgtgtatcattttgtgtatgcgccgcagaagatacatgttttccgtcacacagcacggaaagtaacagggaaaacagcattgcagccacacatgccacaattgtcagtgtcaggatcactgcatgttttcctttggttgtcagttttccttttctattcatacctcctcctcttgcggccatatttcttccgtctctgtttcctcttcgattacttccgtctctaccagtatcgttttatcgcatgctatggacttatgaaatcctcccggaagtacaaaatcctctgttacccgtactgaaataacacccgaaaccatatcacagctttttacatcaatggaaacccttgatgccgtatgcagctgctgccggatttcctgccggacaaatgcttcaacctccgtgtccgacactccagtcgcataataccggttcagatgatatttaagtacctgcgaaatacagttttccatttcattttttcttgttgaaatactgtagatactcagacaggaaacgatcgtataaactgcgatcatacagcccagtattcctaatattatgtttttcatcgactcctccagtacccttcaaacgctcccgtgtctgtttcacacagtgcgcggctctttggaattcccttttccacaaccacgctcatttccgacaccagcgcaatcaataccagtgccgtcacaaccgcgattgccgtgcctgcgtattgtctgatcagttctttcatcaacagcctccgtttccccaaacctcgatcatctgcataatcaatccctgtctggacagcaaaaactgtcccagcgtgcccagaaaaacaactcctcccaccgcagccagtaccgcactgccgtattcttttaccactgctgccatattctatacccccgcaatcaattgcagaactttcccaagccctgccaggacccctgtaccaatcacaaataaaattccaccaattccatattcttctatgatctgttccatcccatcttcctccttttactttgcatagcttacaaatgtatgctgtctgttaattcccagaaaagcaacctgaaatggaaactgcatttcaatttttgccatatcaaccccatccattccatatggtatctgactgacctgcgaaacggttgccactgtggaattttcattaaaaaatgttactttcagctgatatccggcttcctcactctgcaaaaaacactgttgtaccacaccggtattaaaatcactgttttcgatctcatcaacaatccgtgcctgcatatcctgtgcattcatcacttccatataggctgccagaattcccattgctgtcaccgccataaaaagagtcaggaatactcccatgaatgcctttatgatctggctcattttgtatcctcctcccttttatccaagtcctgcccctgacagaaatgtcatcataaacactgccatatccacaagaagttttaatgacgctgtcaataccggtgcaagaaacaacagatacattccactgctcagatttttaagccgtcccttttctgcgacatccagcatctccagattccggtcaatcagttccccgatctgccggtctgccctgccactgtttcccatggaaacggaaaagagcatgctcatggcagaatgtacttccggaatctgaaaacttttcaaaaaccgatggtagggaagcacggactccggttccatttccagctgaccaaccagtatatccagatcccgccgcagcaccggtggaacatgctcctgtgatttctgcaaagcaacctgaacgttttcactctgcaaaagcagaacaatatccatcagccatcccggaaatgcacacttgatactgcgtaccagcgtttttttggcaaccgcccgtcctacccggtgctgatttgccatcagagcaaccagaagcagtgccgccgctgtcatcagctgatgtccaaaataatatgcagctgctgcacctgccgccgtcacaacagccagaactaccgacaaacgcttatcttttcgctcatcataccggtaatattcttctattttctttgcatctgcctcatcggtatgtccatccagggccagccagtcgatggcgagatatttctgcgctctcgtaaaaatcagatcatcaaggatcacaactacaatcgtaagcacctgagaaatcaaatttttactgatatcaatttccataaccggcagatataaaatcatcccgcatatcaacaatgacgcagcaattgacatcacaatatccacaaacattttcctgcgttccttcatagaaccacaaatccgctgctcccatctctttttatccgccagaagcaattccaccggtctttctattgctcctccgtaaatctctacatgtacaataaaatcatgtacattttttatccggctgcaggcatattcccgttcgatcatctgcagggaatcccgcatgacatcagtttcatcaaatgtcatatgcatatgatcaatggcgttttggagaactccgcgcatcggaccatccaccatcgccgcatctacattcaccagtgctctctccactttttcttctttgacgaaagcatacaacagcatatccaggtactcggatacctcctcaaattttctctcgtatacgatcttttttttgtaccatttccggtgtccggaaatccgaagcagcagaaaaccgccaatgacaaccgtcgtaatccagtgaagttttaagagcagatgcagcgcatacagtgccgagaggacaaccagataaatcatgtttccacctccctgtctgcatcctttccaagctgctggtccaaaaggctgcaaagcagcgggttgtcaactccctctcttttaaaccgccgcaacagcgattccggaaattctttcagcaccagttttccatcggtcactgccataataattttgtttttttggccttctctgtcaaaaaaacatacctggtcaatataacggtacacctgaccggccccgttctttttctttcggatcagaaccccgacatccattgcctgataaatatcgttttccagacggtccgcatccacacgcgtttcaagcatatttaaaatccggtccgggatattccggacatcgtccgtatgcagggtggtcattccccgtactcccgttgaccacccttccaaaaggtatttcacctccttggaacgcgcctccgagagcatgatccatttaggatttaaccgcaggcttgccttgatcgcatccgcataatcaaaccggtcattgacccgcatctcaatacagtctttccccggattcgttacggaataccggatctccatggtatcttcgattgtgatgacacgctcatttcccggaacatactgggaaaaaaattttacacactccgtctttccaattcccggcatcccgcaaaaaatcagattcattttcgtcagcacgcaattgaccagtactgcaagaatatccctgctgcaatactgttcctgcagtgctttttgtgctgtcagccgaatgaccggcggtgttttccggatgctgatactgcgcccggaacgtgcgatcgactcatgcagaactgtcacccgcagctcactggtttctgcctccagctccggattctgcttgttaaactgctgactgaccacatttgcaatccgctgggtaaactgttctacaaatgccaaagtcatattctcatccacatacgcctgattcacccggtaacgttcgttatagatattggtcagccagatctcccgcccattgtaatcgacatctgtgatctcttcgttcgcaatatatttccacaatggaccgaaatactcttttccaagttccataccgcctccttagggtgttggcagaccggtatttttgttcgcctggtcaataaaatttttcaccagtgtctgaaacgcacttccgatcggtccgcttgtatccgttcccacaactgctgtaatgacaaggatcactgcaagaatcgctaccacggtaattaaaataccgccatattcctgaaatatttctttcatattttcattttcctcctgtatgaaggacgttcttatgggaaaccacagaagaatatctgtgggcacaaaaaatgcggcgattgcatcacatgcattgccgtactgaaaaaagatatttttactataccgttttttgggtttttgtaaatagttctttggtactaaaaaaggacttccgcaccgggaagcccttctttttgcttttaccttagtcattcactctatttttctgccagaaatttttctgctgcaaccatgcgtaccacaacaacaaatacatttgctgcctgctcaagttcggcaagcgacggatacgtcggtgcaatacggatgacagaatccttcggatcttttttgtaagggaacggggaacccgcaccggtcagtaccacccctgcctctttacactttgaaacaatctcctttgcgcatccttccggtgcctcgaaggaaataaaatatcctcctagcggattcatccatgtaccgattccgcgggatgccagttcatcggaaaagatcttctcaacaagctcaaatttcggacgaatcagatctgcctgtttttccatatgtgccttgatgccatcaacattcttaaaaaacttcacatgacgcagctggttaatcttatcatggccaatggtctgaatcgtcagacgcttcttgatatctgcaatgtttgtctctgaggaagcgattgctgcaataccggaacccgggaagctgactttgctggtagaacagaattcaaataccatatccggatttcctgcctttttgcactcctctaaaatatccagaatctgtgcctggtcctctttgtagagatgatgtaccacataggcattatcccagaaaatacggaaatctgcggctgccggctttaaggctgcaaatctgcggaccgtctcatccgaatagaccacaccctgtggattggaatatttcggcacacaccagattccttttaccgtctcatcgttattcacatatttttctaccagatccatatccggtccattctctgtcattgggatgttgatcatctcgataccgaatgtctctgtgatggcaaaatgtctgtcatatcccggaaccgggcagaggaattttaccttatcgagcttacaccatggagtgttgccacaaataccaaacatttctgcacgggcaacctgatcatacatgatattcaggctggagttaccatatataatcacattttccggctttgtcccgatcacatccgccatcagttttttagcttccggaataccatcaaggacaccatagtttcgcagatcggtgccgttttcactctttaatgcagtcttggaatcaagcacatcaagcattcccatgcttaaatcaagctggtctgctcccggctttcctctggacatatccagtgcaagacccatgccttttattttttcatattcggctttgagtgcggtcagctcctgtgtgagttcctctttgctcatctcctgataggttttcatggtaagttttcctccttattattcctctggattttctttgatttttttataataggcgcgaatctgctgctcatatccgttttccgacggctcataaaaaacctcaccggtcaatccgtccggcagatactgctgcttcacgtagtggtttttataatcatgggcatatttgtaaccttttccgtgcccaagctttcctgccgatttgtagtgggcatcctgcaaatgcaccggtaccggcggtgtctttgtctcctgcactacacgcatggccttatcaatggcattgatcgcggaattactctttggcgcacttgccatataagtaactgcctgtgccagtacaatccgtgcttccggcattccgagccgctccaccgcctgtgccgcagctactgcaacctgcaatgcctgcggatcagcattcccgatatcctcagatgccagaatcatgattcttctggcaataaatttcacatcttcccccgcataaagcatccgtgccagataatacaccgcggcatccggatctgatccacgcatgctcttgataaaagcagagatcgtatcatagtgattatctcccgtcttatcgtagttgatgacccgcttctgaatgcactcactggccacatccagtgtaatgtgaatgatcccatcctcactccggtccgtggtcagaattccaagttcaatggcggtcagcgctgcacgcgcatctccgtttgccatgtcagctaaaaactccagcgcatcatcatccatctgtgcatggtaagaacccatgcccttttccgtatcattgaccgcccgaagcagcaatgtacggatatcctccgtggaaagtttctttaactcaaaaatgacggagcgcgacaaaagcgcaggattcacttcgaaatacggattttccgttgtggctccgatcagaatgatcgtgccgtcctcgacaaacggaagcagatagtcctgctgtcccttgttgaaacgatggatctcatcgataaacaggatcgttttctttccatacatgccctgattgttttttgccgcggcaaccacttcctccatgtctttcttgcccgccgaagtcgcattgatctgcatgaactctgcacttgtggtattggcaatcactttcgccagcgtcgtctttcccgtaccgggcggtccgtaaaagatgatggagctgagtttatccgctttgatcgcacggtacagcagtttgtctttcccgacgatgtgctgctgcccgacaacctcatcaagtgtggtcggacgcagccgtgaggcaagcggtgactcatccttcatattctgttgtctcatatactcaaataaatccattcgtatccaatccccatatgaatatcattcaagatctttttgaataatttttgtgtgtatcctgcatttttattctttgcagaaatttttccacaaacttctttacgctttgttctttgcgatatttctatgtaatttctattattctttcatttcccgcttatctcattttgaaagaaaaagcgtcaggaaattcatttcatccttataaggatacatgatttcctgacgcttgacaagttattattgagatttttttacataaatattgcttttatttttgtacagatgctgtaagtgcaccatccttcacgtcaatgaggatcgtatctccctgccgtacctgatcttcgagaatcagttttgcagagagggtctctacatgcttttgcaggaaccgcttcaatggtcttgcaccataaaccggatcgtaaccatgttcaaccacaaagtgctccgcttccggtgacaatgccaccttgatctcacgatcagaaagacgtttgttcagatcatccatcagcagacgtatgatgccaccaatattttcttttgacagtggcttaaacataataatctcatccagacggttcaaaaattccggtcggaaatgtccctgcagatcttccatgacttctttttctgcctccggcgaaatgttgccgtctgcatcaatgccatccagcagatactgcgatccaaggttactggtcataataatgatcgtgttcttgaaatctacggtacgtccctgtgaatctgtgatccgcccgtcatcaagtacctgtaacagtacgttaaagacatccggatgtgccttttccacctcatcaaacaggacaacagaatacggttttctccgcacggcttctgtcagctggccgccttcatcgtatccgacatatcctggaggcgctccgatcagacgagacacggagtatttctccatgtattcactcatatcaagacgcaccatgttggattcatcgtcaaacaggctggcagcaagtgcttttgcaagttcggtcttgccgacaccggttggtcccaaaaacaggaacgaaccaattggtttggtcggatctttgattcctgctttggaacggataatcgcctcggtcactttggtaacaccatcgtcctggcctaccacacgtttgtgaagttcctcatccaggtgcagtgtcttattccgctcgctttcacttaacttcgcaaccgggattcccgtccagcgggaaataatctttgcaatctcttcatcggtgacattttcgtgtaccagagacagatcacggtctttgagtttatcttcctcaatttccagttctttctgtaatccaggcagtttactgtactgcaattccgcagctttttcataatctgcgtcacgctgtgctgcctcgatctccttctttgtgctctcaatctgctctctgaccttgctgacattgtcaactgcatccttttcggtgctccactgcgcttttctggtattaaactcatcacgcaattctgcaagttctttctgcagatctgccagacgctcctgactcagatgatccgtctctttctttaatgccgtctcctcgatctgcatctgcatgatcttccggttcatctcatcaagttctgccggcatggaatccagctcggtctttatcatcgcacaggcctcgtcgaccagatcgattgctttatccggcaggaaccggtctgtaatataacggttggaaagaactgctgccgtaacaagcgcagagtccgtaatcttaacgccgtggaatacttcgtagcgctcctttaagccacgcaggatggaaatggtatcttccaccgttggctcatctaccataaccggctggaaacgccgctccagggcagcatctttttcgatatactctcggtattcgtttaaggttgtggcaccgacacagtgcagttcgcctctggcaagcattggttttaacagctgtccggcatccatggcaccatcggtttttccggcaccgacgattgtgtgcagttcatcgataaacagaatgatctgtccatccgaatttttgacatcgtcaagaactgctttcaaacgttcctcaaattcgccacgatactttgcaccggcaaccagggcacccatatccagcgcaaacagcttcttgtcttttaagccttccggtacatcgccttttacgatacgctgtgccagaccctcgacaacggcagtcttacctacaccgggttcaccgatcagcaccgggttatttttggtcttacgggaaagaatccgaaccacattccggatctcctcatcacggccgatcaccgggtccatcttctgctgtcttgcacgctccaccatatcataaccgtacttttccagtgtatcatatgttgcttccgggttatcggaagtgacacgctgattgccgcggacggtagacaatgcctgcaaaaaccgttcccttgtcagcccatattctttcatcagtgctttcatcgccggatttggatatttgagcattgcaaggaaaatatgctcgacagagacatattcatctcccattgcctttgcctcatcctctgcatggatcagcacattgtttaaatcttttccgacatagacattgctgttgctgccggatactttgacgcgcgcatccagtttgctgatcgcattctgggtgaaatgctgtacgtcaatttccattttctctatcagtttcgggatcagtccctcttcctgctgtaacagggcaactaacaggtgctcctgctcaatctcctgatttccatagtcgtaggcaagcttttcgcagttattgatcgcttctaccgacttttgtgtaaatttctgtatgttcatagcaagccctcctcttaactatcatcatgtaactgtgctgttttttgcatcccagttactatttttctcgattacgatattgttatacacccgtttttagcactcgtcaagtaggagtgctaacaaaaattctaaagtttttataaacattggaatatattgtcgaattgtctgaaaattgttttagacataagttttttcgatatgacgaaagaaggggaatattctctttctccagaaacatctgttattaattgtaacggatgttttgccgatataatagacaacacaaacgatgatctattacagaaaggaacttttcatgcagatttatttatcactgatgtcccagaagaatccctcatccgattcctcatcctatgatctttcttctcctcaggggcgcatgctctatgtgagagaaacaaccaatgccgcattttcttcctggacttctcccctgcaaagacaggaccctgatacgcaggaagaaaaaaaacaggaaatgctctcccgcattatgggaaaattaaaaagtgggaagaaactttctgccaaagaactggattttctgcggcgtaccgatccaattctttatgcccacgccctgcgcgtccaacgaatggcggaggctttaaaacagcagctctcccatgcaaaaagcaagcaggaagcaaatgatatgattacatccgcgattgccggggtctcggacaaagatccggacaaagaatatctgctggctgcttacaatgaggtttccaaaaattttcataaatcaccggcttatcagcgtctgccaaacactccggaagatgccaaaaaaagaaaaacgaacaatccgaatgctcatttttccgatgatgaggacacgaatgacgatacggatgatctcctgtcatggaccccgcttcaggaaattattgatgcggctccaacactagaatgtcagggctaggcttatatagctggaacattattatttcaagtagtgttccagcttttcatttacacacagacggatttcctctgcaacacgttcacagtatgtctttttcatacccgcctgcacaccaactgctactaattcctttttccccggatttttgccatttccatctacagtggttgtgtgctcactataatacgtattactgtatgtgagatcataggcaggacttaaacgccacatatcatccttttcattataaatgtaggtaaagtttttagaatgatcatcacgattatgtgcgaatacattaaaacacatacgacgatacatattttccacatcctctgtacaatcccttgtcagaatttttgtcaacttcatcaattcatgatagtccagacttggttgattaaaatctaactccaataaggcagccgcagttaacatatgtgccctttttatttcattcttttctattcttcgatcaaatctctttgttccaaaatatcccggacatatatctgatgaaaaaagccgtgtttcactcattacaattccacaggcttttgcacacagagaataatcgtattccatttttcccacatcttttttgtccacatgtgccggaaatttaataatccagttttctccatctatttccgtcataatcttaggtcttgcaccaccactggttcctcccagccggtacaattcatctaatttctccgaatattgcgtgcttaatattttctggcaatgcacagatagttcgtccagatcatccatctgttgtcccatcccaatctccttctgcggatgataggtcaaagctcccattccagattttcccacgatggcaagacgatccaataccgaatattgtgcttccttttttccacgttctttcagcaaacgctccaataaaagctgtccccatgcatccggtaaactatctgcaaatactccgaacaatccgtcaaaataatcttttttgggcacaaacacttcattttttagcggaagcgaaaatggactgactgaaaatccatgctccagccattcttcactataagaaaatgccaccttatgattcgcggtcaatgcaagcgttcccacaagccggtcatccatccgaacctcaagactttccctttgactcattgattacctcctgaatatttcgatatggtacctgtgtaaaaagatcccgcagttcatctgcaagttccaacgccatagcaagttttgtcagtgacaaaagcgaaatctgtcctgttgtctcaaatcgtttaatagaaccgtaacttactccgctcatatccgaaagtttctgttgcgaaactttccgccgtctgcgaatacggcgcatacgttctgccagttttttatccagttcttctgctgtttcccataccagtgcttccatatcatgccccatcttgtcagataatattttatctatttcacgcgattttacttatttttatataatatattatctaatattttagcatatctcttcgggtaccgcaacgtctccctgactatttttcctatcatacagtttttccaaaactgctccaatatccgcttccacgcaaatggatttctttcggatttcctccggcgcacaggcttccttcttatttatgcaggcataaactgcatccggccaggttgcatatagatatatcggctccagtacgcccaatattcttccaatgttttataagggaaaaagcccccggaatacatatccgaaaatccatgcacctgtcggaaatcgccaaaccacttttcaaaacgttccccggaataggtaaatcctgcagaagtggataatcccgcacccgcgccaatgatcacggcctccgctttctgcagtgcctgtttcagacactctgtttgtacacttttgcagtttgatgtttttatactgcaaaatggtggattattgcccctacactttgctcccatacatgggcaccacgatacacttttcggcatatttacttccatcggttctcttatccattccatttcatcacctcctttacacttccttcgtttcttcatattccaaaatgtcacccggctgacactgtaatactctacaaatcgcttccaatgtagaaaaccgaatcgccctaacctttccagtttttatattcgacaaatttacattcgatattcccacttcttctgcaagttcttgcagggaaatttttctatcggccatcacccgatctaaccgtaatacaattggcatcttatatttcctttactttatctataatatttcatcagcctctttctgcaattcgtacccatgttgaaaagaaacaccaatgaaataaatacagattcctactataacagctgctccaataaaatgatccgttcctttccattctaccccttttataatctggcatgctgctaaacttaaatatttcaggcatttaataaccggatatccgattacaaaacataaggctatccccctacattttcaaattgtttttttactttattttcgttctttctttcaaacattttttattctcctttcttgtatatccctttcttgtatatcacaatttcactttttatgtttgtcaatatatttttaatgtttatcgttaatttatgacaaaaaatcccaagagcgatgccagcatcgatactcatgccacaaaaaaggggctgtaaaaaaactcccctgacagaaaaatcgcccagaccgtgaggtctgagcgattttttggtataattaattatgctactaaataacaataccaatggtaattatactatgcgtcagctgaaattaccattagaaatcgaaaaattgatcgatatttccgatccggtatacactttttgtgaggttatggatcacattgacctatccagatattttgtagagaaaggctataaaacaggtcgcccaagatgtgatgctcaaaaactccttaaagtaatactttttgcctttatggaaaatggcatctgctccttacgggaaatagaaaagctctgccgtaatgacattcgttacatgtatcttcttgatggcatgaaaacgccttcttttgctacatttggaaacttaatccgaaacgaactaaccgattctatcgagcagatatttgaagacattaattcatatatttttgccaaagatcacgtggatctgcagcatacatacattgacgggacaaaaattgaggcaaatgccaatcgatatacctgggtatggaaaaaatcgtgtgtgaaaaaccggcagaaagtctttgacaagatttcactcttgattgatgctatgaatcgggaagtacttggatatctcggaataaaatttgaaaagcgtgaagcgtacgcggttgactatgtctctgaattacttacgatgtacaaagaaacaaccggactggatgaaacttctttcgtttccggacgtggtcatagaaaaagcattcgacaaaaacaatacgaagaattgcatgaatatctggaacgtttgaaatcctatgcatatcatatcgagacctgtggagaagaaagaaacagttattccaaaacagatcatgatgcaactttcatgcgtttaaagcgtgattacatgggaaacgatcagctacttccggcatacaacctacagacagccatctgtgatgaatacatagctgtaatcgacgtaaaaccatatgcatccgatatggaatgctttgttcctttgatggaaaaattcaatcgcacatatggtcactatccgaaatatccggttgctgatgccggatacggttcttacaataattatctttattgtgaagaacacggcatggaaaaatacatgaaatttaccatgtacaaaaaagaaacgacggacaaaaagtatcatgagaatccgtatcgtgctgtaaactttgtaaaagatgcagatggaaatctcttatgtccaaacggtcgaaaattcctcttcaagagaacacagcatgtgaaatataataaatatggaagaacggaagaattatacgaatgtgaatcttgtgaagggtgtcagcataaacaagaatgttgtccgagagcacataaaaaccgaacgatccgaatgaatcaggaattaactgctatccatcaggaagtgctgcaaaatcttgaatccatacatggtgctctcttgagaatgaaccgaagtattcaatcggagggaacttttggtgtattaaagtgggataaagcgtataaaagattattgcgaagaggcgagaaaaatgtaattctcgagcttacactgatttcatgtggattcaatctttataaatatcacaacaaaaagcaacgacagacgaaagttgcataaaacttaagcgggcgtgattagccgagctttattaaatgcaccattttttatacccaaagatgcagacttgcttagaaatagaaaagttaatacaaagaaacgccaaaaccgacatttgccggaattggcgtttcttatattagggacttattttacagccccttcgatatttcattatccttcaatcgcaatatatttgttttcttctaccgctttctttgcctctttcttcggcacgaacagctttaagataccatgcttaaattctgctttgacatcctcctgctcaatatcttcaccgacataaaagcttctctggcaggcaccggcataacgttccctgcggatgtagtgaccgctgtctttttctttctcgtccttatccagtccctttgcagcactaatggtcaggtagccatcggaaacagaagccttaatctcatccttggtaaatcccggaagatcaatcatcaactcatatccatccttctgctctttaatatcggtcttcataatccttccggctttcttaccgtatagcttcttttcggtattattcatttctttatccatatcataaaatggaaactcatcaaaccagtcatcaaataaattctctccaaaaatactaggcattaacataagtcatctctccttttctttctgcgtccacggtctgtggacctctcatgcttgtttaccttgtttctttggaaccaggatgtttcaggaacctttcgttctcttttggttcccttcctttgttcttgcctatgttatagcactgtttgttagcactgtcaataggtgagtgctaattttttgagtttttttttgcacaccttgattttgcttggtatgcagccattttttctttccaactgccaaagatgggattttactataaccggattttttatttcgcgcactccataataaccgcttcacatctgccatatccaagctgtgaactgttcagacacaacgtgtaattgctggcctttccccacttctgcccggtataaaagttataatttgtcatacgccttttatctatatcctctatcagctttgctgcttcctggtcactgacattatataaccggctgatacgctgtatgcatcatccagaagcattcccttggtctcaagcaattacctgcagtgtctctcccgctcccttttttaaacatataatgatttataaagcgttactttttttctctgcacggtcaagataaatataaaatccaacatttagcacgattcccaccattgtcgatactggtgccgcaagaccgatcttcgtcaggcttgcattcggctggatactcatcacataggcaaatggaagacgtaccagcaatgtctggattaatccctgtgtcattacccataccgtcttgttattaccattgaaatatccgaccatactgaacagaattgctgtcacgattgtttccagtgcgaatcctttcagatatgcataccctttctggataacggctacatccgttgtgaagaaccctgccagtatatcgcctccaaacatcaccaataaaaatactatacatccaacaaccaggccaacaccgattccggtaaacatggatttcttcgcacgctttgccttgcctgctccgatgttctgagatacaaaggatgccatcgactgcatcagcgcacttggaaccagcatcgcaaagttgacaatcttacatgcaacaccgtaacccgaagaagcttccaggccaagccggttcacaaatgcacaaagtgccaggaaggacatctgtgtcaggaactcctgcagtgcaagcggaagtccgatctttaggaatttcttacactgactattcaacccgaaatcttttctggcaatcttaaatggaagttcctttttgatcagaataacaatagcaaatactacgctgagtgcctgcgctgcaacagttgcaatcgccgcacctgctgcgtccatatgaaatcctgccacaagtactatatctccgatcacatttacaatacatgcaacaaatacaaatagcaacggtgatttactgtcccccagtccacggaaaattgctgataaaagattgtatgcaacaataaagaaaataccgcctccgcagatacgcacatataccgaggtcagctcaaccgcctctttcggagcctgcatcaggactgagattggatgtgcaaatccaaccataacgataaataatccgactgcaatcatcgtaaatacaactgctgatccgccaatgaccgatccaatctgctctggtctcttttcaccgagatatctcgcaatcagtaccgtaatacccattgcaaactgtgtcactacaaaagttacaagattcaatacctgacttcccgtagaaaccgctgaaagcccggatgtagaaccgaatcttccaactaccagaagatccactgcaccgtatgccgcctgcaggatcaatgctcccagcaccggtatcataaatgcaatcagttttttaagtatgcttccttgtgtaaaatctgccttatcgttcatcgtaatgttttctcctttcgcacatgatctgataaaatttctctatcgtccgtatcatacattctgcatcttcgtccgagatttcttccatgtaagggagcagacttttaaaatattgttcgtcatatttctgcgaaagatttgttccctttcttgtaacagctatgtatgtgacacgtccatctgcttcagaagccattttcttaaggtatcctttttcttccatctctttgacagttcttgtaactcccggtcttggaagctccattgcatcactgatatccgacacctttacctgtacgccctgtccttccaaagactgtatcgtatccagatattgaataaaggatgaacgaacaccttcgggcaacggtgggagcatctcccgggtccgctttgcctgataacatgcatcgaacatcctttttattatttcacttgtcatattctgtcctccttatatattatcagtaaaatcaccacttatactttcttttgcattcatggcacttctagtaattatcacagttaattacctttgataattatataaaaatttagaaatttgtcaagcttttattccattgttaacagctgatccgctgaaaatttatcatcttcttaatatcttccggaattttttcccagatttccgcagacacatattccatatttttccaaatctacccttccatttatcacttcaactccatccgctcgaagaagttctgcctgtacatcctctccaccaaacgcaaatgccccggccagttcacctttcgcattgaccactctgaagcacggaatatgttccggatccggattcttatgcagtgcattgcccacggctcttgccattctgtggtctcccgccatctctgcgatcttcccataagttgccacatgtcctttcggaatacgcttcactgcttcatagattctctttgtcggactgtccgtaaccagatcatacccagacaatctgatctttctctttatccggcaaaggctcttttttctctagctgtttcagaatcacttcttcccgttctctggctgccttgtctacttccagaagatgctctccaatggtgtcctgcagaagcatcacctgataagttgaatttcgatggttcttcagataatctctgcgaagaaaaccatacttgccaagttgctccatctgctcaccggatttataggtgagattcgggatcagatatccatttacatttgtatacgttatataaataggacatttgcaatccgctttcgctacttgctcatgaacgcagttgcttcgctgcctgcgttcattttattagcactctccatttctcatcattttttgaccacaaatttacgacatttacaacaaatctgacactgctttacaataccagacaaaatggctgatgccccggaaagcctgtaaaacaggcacttccgggatacacaaggccggacaaaaatcgacttccattatcaagtatcgagtgctaattttttgtgaagattttttaacgtcttaattttagtcctgttttcctattgtgcatatgtttcttccatgctatattttctttacacatttcgaatttgcagctaaatttatataccgctgcatttcaccggatatttcatccgttttttccatgtgtacgaaacaattaaatattggagaggaatttcgtgcagagcaaaaattcagttattattttattattgtttttattttcagatattgaaagctggggggcttccatgttacaatcttgatagaagaacagccgctatatcacacgttttcctctccgccactacaaaggagaagaaaatgtacaagagcaaaaagttcgaagaccttaccattagtgatgattttatgtttgggattgttatgcgcgatcccaaatattgtaaaccgtttctggaaactatactgaatattaagatttcacgcattgagtatcccgaggatcagaaaacgattaatctgtctctggatgcgaagagcatccggctggatgtgtatgttgaggacgattttgatacggtttacaacattgaaatgcagaacggacaccataaaaatcttccgaagcgcacccgctattatcaggggatgattgatttaaacctgctcgacaagggcatggattacacgcagttgaaacaaagttttgtgatctttgtctgcacctttgatccgttccatatcggcaggcatgtgtatacttttgaaaaccgctgcgtggaagatccgaatctgcctcttaacgatggcacacagaaaatcattttaaatacgaaaggaatttttgatgatgttcggccggaactgaaacggctgcttaactttattgatggcagacagccggaagattcttttacacaagatctctccaaggctgtggaatctgccaagcgcaatgagaaatggaggcatgactacatgacgctgcaaatggcttatgacgagaaataccgcgaggggctggaaactggcattcagcagggcattgaacgaggcattacaacatctgcccgtcgtatgctttcctccggtaaatattcggattctgaaatttctgaaattaccggactttccgtggaacaaattcaagctttaaagaattccgcaaaataaactcttattatttttaattcaatactttataattcaagaataatcttgaggttattgtcctgtacgcttgctcctacattaccatcaagagccagacataaatccccgtattgtaaacaggcagccgaacgattttcaaactgtactctgcgcagattgctttcgattctggcaagcacttcttccatatcaaaaggttttgtaatgtaatcatctgccccaagacgaagcagatcaattttattctgtgtcgtttctttcgctgaaataataagaaccggtatcgtaaattgtctgcgtatatctgccagaataatatcgccgcttcgatagggtagcataatatcaagtatgatcagatcaattttttctttgtgtaagaaatccagaacatggagtccatcatattgactgtacacaacatatccgttttctttcaggaaatctgttaacagcgtattgatttccacatcatcttcaattattaatattatatccacttgtgtacctcttttttacaggcaataaccttcttccctgagtttctttccctcttcgatataagaaagtgcactctcttttaaccctgcaatttcttcttccgtcaatgcccgcgtgaccttcgccggtctgcccataaccatgcttccatccgggatattctgatgttcgagcacaaggcttcctgctgcgatgagacagttttttccgatcacactgccgttcatcaccgttgcgcccatgccgattaatgtgttgtccccgatcgtgcagccatgaagaattgcattatgccccaccgtcacataatcacccaccatggtcgggtcgactttggaagtgtgaaccgtgcagttatcctgaatgtttgtcccttttccgatgataattttattgtcatccccacgcagtaccgcataaaaaagaatggtactgtcctcaccgatggatacatcccccatcactaccgattcctttacgatattggcggatgccgctatatttcccgttgtttttatcatgaccgatttcctcatttcttcatttcatactgtttttagtataacatctccgttttttcttctcaacatgctcctggaaaagaaaaagcgaggacatcagcagatgctctcgctcgactccattttacgatttattcgtaaatgtgtttctttttatcttttgctttcgcctgttttttctttaacgggtgttttggattcttatctgacatagtaatcgcctcttttcctcatattcatatgtcaaatttgtttcctttgttatgcctacgttatagcactgtattctggcaatgtcaaccctgtctgttaattattttgtgttttttctgtgaatatgataaatttactcattttaacgcaagttgtcaggcattttgtgtttgtgttttttctgtgaacttacaaaatcctccaaaaaaagccattgacattttaaattttcatccctataatgataaaagttcggttgctaactatttaaaatcattttaagaaaggagtgatttcttgcaggatttcgatgaagaacaactcaaagaaattcatatgggccgcctgatccaggtactgtcccatcagatgaaacggaaaagctgtgtgaactccatgatcaacgacgatggtctgaccaccatgcagaaacatgtgttgaaatttcttcttctggaaacccttcacaaggttgtctaccagaaagacatcgaagaagaatttcagatccgcaaatccacggcgaccggaatgctgcagcttctcgaaaaaaatggttttattgtgcgggaaagcgaaaaaaaagatgcccgtctgaaacgcatcattcctacaaagaaagcggaagcactccgtccgagcattcttgcacacataaggcagtcggaagcacagcttacagcggatatttccgaagctgatgttctgacctgtaaaaaagtgctctaccagatgctctataacgtatcagaacataaggaggtatgtaaaaaaaatgaataagaaacttttacaatccgtccgggaatacaaaaagcaatccatcattacccctcttttggttacattagaggtactgatggaagtattgattcctctggaaatggcaaaaattattgatattggcattgcagaaggaaatctcggatatattatccaaagaggacttatccttgtaattatggcaatgatgtccctgtttttcggtgtacaggccggaaactttgcagcaattgccggagccggatatgccaaaaacctgcggcacgatatttattataaagtacaggatttttcctttaaaaatattgaccatttttccacgtccggtcttgtaacacgtatgactaccgatatcacaaatatccagatggcttacatgatgagtatccgcctgctggcaagggctccgatcatgattattttatcctgggttatgaccctgacgctcagcagaaaagctgcgctcttatttttaatcgtcattccggtactcggtggcacgctgttatttatcgcaaaaaaagcccatccacatttcattaaggtgtttgacgaatatgatgaattaaacaattccgtacaggaaaatgtaaatgccgcccgcgtggtaaaggcatttgtccgtgaagattatgaaattggtaaattccacggtgtttccaaatatgtttatcaactttttaccacagcggaaaagatcgttgcctggaattccccagttatgcagtttgtcatgtatgctgtgattatgattcttatttacattggcggaaaaggcatcgtaaccggaaccatggaaaccggtgcacttacttccattattgtatatgccttacagatcatcggttccctgatgatggtaacatctgtgtttgtcatgatcatgattgccggtgcatcgaccgaccgtatcacggaagtactaaatgagattccggaaatgcgcgatcctgctgatgctgtaacttccgttaccgatggtgatattattttcgaccatgtcggtttcagttatgccggtgaaggtggaaatctttccttaaaagatgtcaatctgcatatcaaatccggtcagaccgtagggatcatcggtggaaccggaagtgcaaaatcaacgcttgtacagctgattccgcgtctatatgacgtcaccgaaggaagtgtaaaagtttccggtatcgatgtgcgcaaatataatctggaagccctgcgcgatcaggtttccatggtgttgcagaaaaacgtcctgttctccggaacaatttacgacaatatccgctggggcaacgaaaatgctaccgatgaagaagtacagaatgtctgtaaactggcacaggccgatgggttcgtccgcgaatttcctgatggttacaatacacagattgtccagggtggaaacaacgtatccggtgggcagaaacagcgtctttgtattgcccgtgccctgctgaagaaaccaaaaattctgatccttgatgattctaccagcgccgtggataccaaaaccgatgcgctgatccgcaaggctttccgcgaggaaattccaaacacgacaaagatcatcattgcacagcgtgtttcttccattgaagatgccaacttgatcattgtccttgaaaacggtgagatttccggcattggtacatccgaagaactgttaaaaaccaatgctatttaccgtgaagtatatgaatcacaggtcaaaggaggtgaagatcatgaataacaaaaagccaaagctttccaaatacaatattgctaccgcaaaacgtctgttgaaatatgtaacagaaacctataaagcccgctttattcttgtatttgtatgtatcttcttaagtgcagtcgcatccatttcggtatctctgtccttaaaatacatgcttgatgatttcatccttcccctgattggacaaaaaagtccggactataccgaattttaccgtgcacttgctgtacttggctgtattttcattgtcggtgttattgcaacatttatctatacccgtatgatggtatatatcggccagggtgtgttaaagcgtgtgcgtgatgatatgtttgagcatatgcagacccttccgatccgctatttcgatcagaatacgaatggctctatcatgagtctttacacaaatgataccgataccctgcgccagatgatcagtcaggcaatcccacaggcactgatgtcgtttttcaccatcattgttacatttatttccatgctggtcttaagtcccctgctgacactgcttgccattgttgtcatcgggattctggtatttgtcacaaaaaaaatcggtggaaacagtggaaaatactttgtgcgccagcaggtttcccttgccgacgtgaccggatttgtggaagaacatatgaatggccagcgtgtggtaaaagtgttcaaccatgagcagaaatccaaagaggaattcgaccagctcaacgaagcactgtttgacagtgcctcacaggcaaacaaatacgcaaacatgatgggaccggttatcggaaatatcggaaatttacaattcgtgctgactgctgttctcggtggtgttctctcggttgccggtgtgggcggcattacgctcggcgtcatggcttcctacctgcagtttaccaagagttttacccagccgtttatgcaggtggcacagcagttcaactccatcgttatggctctggcaggagctgatagaatctttgccctgatcgacgaaaaaccggagacagacgaaggctatgtaacacttgtcaatgcaaaaagagatgccgatggcaacatcatcgaatgtaaagaacgtaccggcatgtgggcatggaaacatccacattccgcagatggaagtgtatcttacacccctctgaccggcgatgtccgttttgaagatgttacattcggctacaatccggataaggtcatcttaaaagatatcagcctgttcgcaaaaccgggacagaaactggcatttgttggctctaccggtgccggaaagacaacaattaccaacctgatcaaccgtttctacgatattcaggagggaaaaatccgctatgacggcatcaatattacaaagattaaaaaagacgatctgcgtcgttccctcggtattgtattgcaggatactcacctgtttactggaaccatccgtgacaacatccgttacggaaatcttgacgcgacagatgaacagattcaccaagcggcaaaactggcgcatgctgaccagtttatccagatgcttccaaatggctatgataccatgctcagcggcgatggtgaagaattgtcccagggacagcgccagctgctttctatcgcaagagctgccgtggcagatccaccggttctcatcctcgatgaagcaacgtccagcatcgatacccgtaccgagagtattgtgcaaaaaggtatggataacctgatgaaaggtcgtacggtttttgttatcgcccatcgtctgtctacgatccgaaacagtgatgcaattattgtgcttgatcatggacagatcattgaacgcggggatcatgcggatctgattaagcagaagggaacttattatcagttgtataccggaaagctggagctttcttaaccggctgtttcttcttaattggaaatgatctcctattgcataaatattacacacttgttacaatgcttttgtacttagctaatacaaatacgaacagggaggtacaaaaacgatgtgttttagatttttttccaactgcgatttctcagcactgatccgtaagtgttttggatgctaataaccagcaaaaaagaagctgcacacgaatttccttttcgtgtgtcagcttctttttgcgtttcctgtctgtattcacctgaccggtccgtctatgcacggaaatcaaatttattttttgatatgttgatttaaaaactccattacttctcgcttctttggaatcgcaggaattccacctctcttttgcacacacagacatgctactgcatttccatgccgtgcacaggcacgcaaatcattccagtccatctcatcaattgctttgttcagggataaaaactggctcaggaatccaccccagaatgaatctccggctcctgttgtatcaaccgcctctgttgcaaatcccctgatctgttcttttccatccgtagttgccacaagtacgccgtcactgccaagtgtaatggcaatcagctctggtcccatggaaagcaactcctccgcagcttcttcatagctgttttttcccgtcagcaggagactttcttcatccgataccttcatcacatccgcaaatggaatcactgctttcatttcctgtactgcagtctgttcatttctccacaaggatgcacggtaatttggatcataagaaatcaatgctcccgcgtcttttgcgatatgaacggcttctaaagttgcactttttgccggttcatccgtcagggaaagcgatccgaaatgaaaaattttacctttttgcaaaagcgtcggatccagttcttctttccgaagttgtgtatccgcgcccggttttcttgcaaatgaaaatttccgctcaccgttttcatcaatttctacaaacgcaagtgtagtaaaatacttatcatcttcgatcagatggtccactgcaatcccctcattttgtaaggttctttttaaaaatgcaccatgcatgtcttttccgacttttccaataaacgatgtccggcatcccatatggcttgcaaccgtcaacaaattcgccggtgcaccaccgggattctgctcaaacagcttcattccatcttttccgtatcctgcctcggtaaaatcgatcagcagttcacccaatgctacaatatcaacctctttttccattctttaattcctccacaatttcattataacgctttttattcagccggtaaaagaataataccaccgcagtcataatccagagaacccccggaatagttgtaaatgcatgtttcataatggaaagtacggctgcattttgtgtctggtttgccacatacccgtattttccgagtaatccagcaagaagtgctgttccaattgccattccaatcttgtttccaagcgaaataaacgcatattgaaatccatcgttgcgcaatccggttttccactcaccgtactccacacaatccggaatgattgcataaattgcggtattgaatccggaaaagaaaaactgtgtaattccagacaatgcataaaagataaccggagcttcttttacattaaagaaaaacatggaaagcatcgaaattcctgtcaaaagtgcaaatacactggcagttcttcctttattgttcagtttacggaataccggctgaaagcaggctgctccaataatggaaggaataatgatgcacatcgaataagtggtataatacgaggcatttccttctacataagtaaaataatacaggacatccgcatttcttccatataaagtaaaaccaaataaaatctgtcctaccagagccagcagatacggacgattctgaagcaccgcttttagctggacttttatagaaattttttctttttccggtgtgatcacagcctcttttgtctttgcaaagcaaaagaaatgacatgctgcaaaaatgcatccataaataactgccaccgtcagatatccggtttttgcactgctgcttccaaatttgttaatcaaaggaacggtaatgatatttaacacaccgattgcaatcattgctgcaacggaacgggaagtgttgatttttgcacgctcatcaatgtcctgtgtcattgctccacagagtgttccatatggaatattcacacaggtatatcccaaaacaaggagacaatatgtgattaccatatatacaatttttgcagtctgattccagtctggtcttgcccagaatgtcattacaaggagcaccgccgtaatcggtgccgccaccaaaagccatggacggtatcttccccatcttgtctttgtcttgtcggtcagtcccccgacaatcggatcattaatggcatcccagaatcgggaaaacagcatcagtgcagacactgctgccatactgattccaaatacatcggtataaaaaatcattaaaaaattgctgacaaacatccaactgaaattacatcccacatcaccaaaaccatatgcaattttgctgatcagcggcacttttccacttctgttctcgctacccatacgttcctcctacttcatcagagtttctggcaaaactcgattctctcctcattcggtcctttaatcatgaaaaactttacgccattatcccaaaacggaagctgctcaattccatccgtaatgacttcatatccattttcacagatctttttatacatttcttcaatatctctcacatccagtgcgacatgctgatatgccccgtctgccatcactgcctgtccgttctcaaacgattcgatgcagtaattctgaatctgcaaaaacgcaaccttttcttttgccttttcattataggtttctaaaatcacttcaaatccaagacttttataaaattcgattgtcttttttaaatcattcgtcgggagccctatgtgggctactccgacaattccatattcgtttttcatctatttaatcctcctgcacattgataatgactttcatcgttgtctcacggttatcatcaatatactggtatgctttcagataatctttaaatgcaaacgtttttgaaattaatggtttcaaatgtacctttccctcattgacaagacggataccatctacataatcgtcatgccggtacatcatggtacttttaatatcgagttcgtgatcatttgcgactgccagatccacctctgccattcctgcaaatactgcaaccagtacgatcacacttccttttcttgcatatttgattgcctgccccatcgtaatgttatttcctgcacagtcatagatcacatctgccttatccggaccaaatgcctctaccatagcctctccaaaatctttgtgcagcgtattgacacatacatcaattccacattcttttgctttttccaaacgcagatcactgacatcggtaatcataacctttgctgctcccatcccttttgctgtttgtgcaacaagatttccaattggacctgcgccgattactgtgatattcattccttttacatcgcccatctgctttactccatgaactgcaactgcaagaggctcgatcatcgccccttcttcataagacatatcttccggaatcggtgttaccttagatgcatctactgcaaaatattcagaagccgtacctgtggtctggaatcccataacctttaattcctcgcaaagattatattttccatggcgacacggatagcagtgtccgcaataaacctgtggttcaatcgtaactttctgtccgatctgaaacccggaaacatttttccctatttctgcgatttctccggaaacctcatgtccctgtgtcaccggatatttcgtaaacggatgctttccatgatatacatggatatcagaaccacagatacctatatttctgatttttaccagtacctgatcatccttgacttctggaaccggaacctctctaaatgtaatttctcctggatttgtcattacctgctgtaacataattgtttcctcctttatatttgttcttcttttgttttatcttttataaaatgttttattaaagtaattacattattgtcccattcctctgttttgtcaatagtttttgagagtttttaccagttgcacaattttttattttactttttgtacaatttttctaaatttttaaacaaaaaagttccctctttaccgcatatacacgccagtaaagaaggaacttttttaatttcatcattacgaacagcattcttttacatattcatacaaaaaatgttttgccgcaccaaccgccgatgcttctttttcataagaacaatttttcagataagaaatatccctgtcaaatccattgtaagacaataccctctgtcccaatggaatcatatactctgccagtacacctccgacatctcccccaagtataatatccatatcgtatgccatccgaagattggatatcaggatagcaagatgatccagatatctttcccatttttgttcagcttccttatttccctgtttcaattgttccataaatacttccagagaattttttccgtccccagtcagcacacttgccgcacaataagcatctgcacacccctgctttccacaataacatctgtcccctccgggaatcaggatcatatgtccaaactctcctgccttctggttctgtccacgaaacagttttccatcaatgcaaaatgcccctccaagagtatgatttaaggagaggtatatcgcattgttatatttttgtgtatcttccgcaagcatagcggaattagcatcattctcaaaataaaccggaaatcccaatgcctgttccaaaaaacgcagactgtaattttctacctgaagagcatgcgattttagaactgtcttctcattctgatcgataattccgggaattgcaattccaatccctaaaatatctttctccgttttgcattctttcagaaactgttgtacctgcccggcaatttttacactataatcgatatccggtgaaaattttaaacggacacgtttcagatgttcgatttcatatcccagatttacgagtaccatttccagatgattagcggtaattacaagtcccattgccctgcaatattccttgttaattcctatgcttttggcttttcttcccccggtagatgcatactctccattttctacaatcagtccctttgcaatcagctcattgacatttgtcagaactgtaggcatactaagccccagttcttttgccagttctgcctttgatgtaacggaatggttcaacatgtaattaataatttcagttcttgctatattgcgtttttctcttttttccggcataatcttcctcttaaataaagtattttataaaagtatcatatgcttttatttattatttgtaaagaacaaatttcatcctatatccagacaaaaaaccgctgcggctgcaacggttttcattctgtctattattcttattttacggtaacggtctttactttcgaccatgcagaatatgctttcttattgttgccgtttccaagaaattattttgtaaaatttatccctgtgcataccgtgtcaggaactgctttgtccgctcttccttcggatgatcgatcacctggtgcgggtctccctgctccacgatcacaccaccatccatgaaaatcagctgatctgccacatcacgggcaaatgccatctcgtgtgtaacaatgatcatcgttgttttctgctctgccagtgtgcggatgacttttaaaacctcaccggtcagctccggatcaagtgccgatgtcggctcatcaaaacagagaatatccggttttaaggcaagagcacgcgcaattgccacccgctgctgctgtccgccggacaactgatgcggataatgatccatacgctccgcaagtcccatgcgctctaacagctgtcggccgtgtgcatcaatttcttctaagatctttttcttattctgtttgaaatccggacgttcctgtgccagaagctgttccgcaagcgtcacattctgtaacgctgtatactgtggaaacagattgaatgactgaaacaccatgccaaaatgcagacgttttctgcgcagatccgcatccttttccattccggctgttgatgcatcaaacaaagtttctccattgaccgtaatcgttccgccattcgggcgctccagaaaattcagacagcgcagaagcgttgtctttccggaaccggaagatccgataattgcaagcgccgtgccttcctccatggagaaactgacatcttttaatacattcgttctgccgaaatgtttttctatatgtgatacctctaagattgccatgttatcctcctacttaaagtaatccagcttacgctcaatataattaaataaaagcgtcaaaataccaataaaaataagataaaatacaccggtgtaaaacagtggccaggtcagaccatcggatttcataaatgcagcaccggcaaaggtcagctcataagctgcaataatacgcgcaagagaggtatcttttacaagcgtaatgatctcgtttgacatcggtggtacgacacgcttgatcatctgaagcagtgtgattttgaaaaagatctgatgctttgtcatgccaagcacctgtccggcttccctctgtccggccggaactccctcgattcctccacggaaaatcacggaaaaatagcacgcataattaatcacaaatgccactacggttgcggtaattcgcccgctctcatttccgctccagacggtcgtatggagccagagccccggtccatagaaaataatgatcagctgaagcatcagaggtgttccacggatgatccagaccagaatctgaaccagacgctgcagcggtttaaacttgctgagcaggccaaatgccagcaccagcccaagcggcagcgcaaaaatcagtgtcagtataaaaatttcaaaagtggtggcaagacctgtcaaaagtgactgtgttactgtccagaacatgatttatttcccctctggtacgacaactacctgtgcattgttacaataagcattggtacattccattgcagaagttacctcgctcgtcagagtcattccattccatacgacatcgatattcttggaattcagttccatgaccttgttgtcccagtcgatctctacaaaatcaacctctacaccaagtttttctccgacaagttttgccatatctgcatcaaacccgatccagtttccatctttatccttataatccatcggctcaaaatcggtcacaccgacaaccagttttcctcttcccttgatgtaatccacgtcactgtcttttggggactgttcaaaggtggcatctttctgctctacaagtgcttcctgaacaccgtaggtttcggcaattttttccatgcttccgtctttataagagtcagcaaacacctgattgatataagaagccagatccgatcctttccggcatccaacgccatactcctcggtcgtaagttcgtctgtatgcttcagattcggataactggtgccctcaccaatcatggcacctgccatcagaaggtcaatgatcgctgcatcagatgtaccggaagcaacttccatcagggcatctgcctgggacgaaacggaattgtactgaaatcccttttcttttgcagcttcttctccggcagatcctgcctctactgcatataccatgctcttttcgctctttccggtatctcctgctcctttggatgcaccacaggcagtcataccaagtgtcagcgctgctgccagcaatactgcaagtttctttttcataatgttcctccattaattattaattcttctgtttactacatgtttaccatattatcatgttatcatgctaaagtaaagaggagtaaattacaaaccttcctgcattttttccctgaccatttttaccatctgaatcaccaatgtcggcacaaatgccagcagcagaatatacccatacatcagcactcccatttccgccacatcgaacagcctctcaaaaaccggaacgcaaagtaccagtcccaaaagaatacatccacccaaaaatgctcccatgctgtacttgttggacccaagtccagcccgtgccatggacttttggctccggcagttaaacccatgaaacaggcgtgccagtgtcagcgttgcaaaagccatcgttgcggcaagcgcggtactctgctgcagccctatataataagaagtcatgaccggacacgcaatcaacgctccctctgccacaattttccccagaaacgaaccggtcagtattccggcagaaggatcccttggtttttcctctaaaagtgctgcatctgccggctccatgccaatcgcaattgccggaagcgaatccgtcagcaaattgataaaaagcagatgcaccggtgcaaacggaactggaagtcctgcaagtgaagtatacagtaccgccagaatcgctgccatattgccggacagcaaaaacaaaatagcattctttatattccggtatacatttcttccattcaccaccgcctgaatgatggtcgcaaaattatcatctaaaagaatcatgtctgccgcatcttttgccacttctgttcctgtaatccccattgccactccgatatctgcgcattttaatgccggtgcatcgttgacaccatcccccgtcatggaaacaatccgtccttttttctgccatgcctttacaattcttatcttatgttccggcgaaactctggcatatacacagattttttccaatttttcctgcaattccttctcactcatggcatctaactcccttccggtcacagccagatccccttcctgataaattccaagctgttttgcaatcgcacgcgcggtaattttgtgatcccctgtaatcatgaccgtgcggattcctgctctctttgcatcggcaaccgcctgaatggcttccggtcttggcggatccatcatggcaatcagcccgagaaagatcagattttcttcgctttctatggtcagcggtccttcactctctttatacgcaaatgccagcacacgcagtccctgcccggaaaattccgcaatcttttttttgattttttctgcctccgtcggatcaagtggaacaattccggtacttttccgtacaaattcacagcgttccagtaatacatccggtgctcctttggtcagaatggttccgaccccgtgcaggtaatatcttgtgctcatccgtttccgctcagaatcaaacggaacctcttcgagacgtttcatacagcttcgaagcatttcttccctgtaaccgccttcgcccatcattccccctttcggcgcgggaattttacgaaacatttccaacagggcatattcggtcggatctccgattccttttccgttctccaatgttgcatcattgctaagcaccgcatcatataccagatatctgtgcagctgctcttccatagaaagctgtccgggcagatattccctgtcatccacataaactttctgcacggtcatcttattctgtgtcagcgttccggttttatccgaacagatcaccgatacacacccaaggctctccactgccttcagctttctgacgatggcattttcctttaccatcttctgtgttcccattgcctgcacaatggtcacgattgaactgagtgcttccggaatggcggctaccgcaagtgcaaccgcaaacatcaatgcatccagaagcggcattttgcggtataaacataaccccaataccactgctgaaattcccataaccagaactgccagctttctgctgaactgatccagactcacctgtaatggtgtcttacggtcccggatatcattcatcatcccggcaatctttccgatctctgtatgcatccctgttcctgtaaccaaaacctgtgcgcgtccataagtgaccaggcttccggaatataccatgtttctgcggtctgccagcggcagatcctccggcagactgccttgtgtcttttctacattggtggattctccggtcagcgcactctcattgacctgcagggaaaaattatccagaatccttccatctgccacaaccatgtcgccagcttccagttccacaagatctccaggaaccagttccctcgaagggatctctttctttttcccttcccggatgacttttgcacacggtgcagacagatttttcagactgtccagtgatttttccgctttctggtgctgcaccgttcccaaaactgcattcatcaccaggacaactgcaattacaatcgtactctctacatttccggaaaacatggaaataagcgcggcgatcagcaaaatgacaatgagtaaatctgcaaactgtgacaaaaagaccttcagaagcccgggtctttttccctcttccagtatattttccccacatgtttcccggattttttgcacctgcttttcggataatccctgctccgtagtagaaaatacgtctcttagctgctctttggaatacttccagtattttttcatggcatgccctccctgtgttgtggtacaaaaaaagaaacgggacttttttgcaccagaataatgcaataaaaagtctcgtttcttcgtgtacagcccggttccagctttcctgtaacgtgatgacggcctgcacaacacccggacacaccggatgcaaactactccctgtttattatctttttgtattttacccatatcctctttcatttgtcaactgctttgtttcttttttcaccacattgcacaaaatatttgtttctttaagcattatatagtataataaatccaaagattaacttacatcagggatttacatgatagaataggagacacgcttatgatgcttacactcattcctttttttgaccggaatatgtccgttagtgcttattctctgtttaccagaaaaaataactttcttatgaacccaagccttcttggttccagacagtttgacggggctgcctatgtagacgggctggaactgattcaggagcttggaaccaccacactctccggaggaaaaccgatttttgtatctttaaataatatctctattttcagcagtctggaatccgagtgcaaaaatacaaaccatgcaccgattctcctgattgaccagacatttcctccggtatccatgtatacagaccgcatccgcgaactgcgcgaattcggatatcattttgcaatccgtaatcttcctgttcactgctacgaagactacgcaccgattctgtcacagatggactacattctgattgactgccagaaaatagatgccgtcaaggcttctttctatttccgcaaactgtatccggatatctgtatctgtgccagcaacattccggacacggaaacattcggaaaactcagtcctgcagaaacaatttctttatttgaaggaacctttttccgtatgccggtcacacgcggtgaacataaagtatcgcccctgaagatcaattacatttcgcttctgaatctgattgaagaagatgattttgacctgaccaaagcggctgatattatcagtcaggacacggctcttatcatctctttgcttcggctggcaaatacacgctcctttaattccgaaatcacttccgtgcgggttgctgtctcaatgctggggcagaaggatctgacgcgctggattcagacaaccgtcattgagaaactgtgttctgacaagccgaatgaactgatgcgcctttccctgctgcgtgccaagtttgcagaaaatcttgcaccggtctttggcatggcaatgcgttcccaggaactgtttctgaccggtcttttctcgattctggatattattctggattgttccatggaagaagctctctccatggtgcgtgtatcgggcaagatccgcaccgcccttctggaacataccggttccctggcagaagtgcttcactttattgtaaaatacgaatcggcagaatggcaggaagtttcccgccagctggtgcttaaaaacatcgaaattccggatgtttcccatgcatgggtttcttccctgcaatggtatgcaaaactgattgccatgaatgaataatgtcagataaaaaaaggatgcacaaaacgtgcatcctcttttattgttttattgtcttccgctggttcctttcagacgtgccatcgcacgggaaagagaagctcttgagtggtaatactcacggatactctgcttctggcgcatctgctcctctgcacgctcttttgcttcgcgggctcttgccacatcgatttcctccggacgctctgcagtctccacgagaagtgtcacacggttattgacgatctcgacaaatcccattccgacaactgcatattcccagttatccgtgccttccggctgaaacctcatctcgccctcatcaatggcaatgaccatatcctcatgatgggccagaatttctttctgcccatcatattccggaacgatcagagaacggcatcttccggaaaagaacacacggttcgcagatataatttttaaatagaatgtattgcctgccataatgatctccgttctttatgctatgcgttctgctccatctgctcggctttcttcttaacatcctcgatagttcctgcattaaagaatgcattctccggatattcatccatctcaccatctaaaattgctttaaagccacgaattgtttctttcaacggaacatatacacccttgataccggtgaagttctctgctacatggaacggctgtgacaggaacttctgaatctttcttgcacggtataccaaaactttatcttcgtctgccagttcttccataccaagaattgcgatgatgtcctgcaattccttgtacttctgaaggatctcctgcactttacgtgcaacctcgtaatgctcctcgcctacgatatccggctcaaggatacgggaagaagactccagaggatcaaccgccggataaataccctgctcaacaatctttctggaaagtacggttgtagcatccagatgtgcgaatgtcgtagctggtgccgggtctgtcaggtcatcggctggtacatatacagcctgtacggaagtgatagatccattctttgtagaagcgatcctctcctgtaattcacccatctccgtagccagtgtcggctgataacctacggctgacggcatacgtccaagcagtgcggatacctctgatccggcctgtgtgaaacggaaaatgttatcaatgaagagaagcacatttttatgctgctcatcacggaaatactcagccatggtaagtccggtctcagcgacacgcatacgagcccctggcggctcattcatctgtccaaacactaaggctgttttttcaagtacaccggattcgcccatttcggtccacagatcatttccttcacgggaacgctccccgacaccggtgaaaatggaatatccaccgtgctctgttgcaatattactgatcagctcctggatcaatacggtttttcctacaccggcaccaccgaacagaccaatcttaccaccctttgcatatggggcaagtaagtcgatgaccttgataccggtctctaagatttcctctgcagggttctgatcttcaaatgctggcggctctctgtggatcacccactttggagcatccccgatcggctttccgtcatcaattgtttctcctaatacgttgaacagacgtcccagtgttgcctcaccaactggtgtcttgataccgcttccggttgcaatgacttccatatcacggtgaagtccttcactggctgcaagcataatacagcgtaccgtattatttcctatatgctgtgcaacctccatgatacattttttgtcaccattttgtacttccagagcgtctctgattgcaggcaattcttcgtcttcaaattcaacgtccacaacaggtcccataacctgtatgatttttcctgttttcatcctaggcctccattatctctttttcttgcgcttctgggattttgctcccgcaattacctctgtgatctcctgggtaatcgctgcctgtctggcacggttatacatgatatccagctcatgaagcatatcctttgcgctgttggttgctgcctccatcgccatcatacgggcattctgctcgcaggagaaggattctaccagcgcaccataaacaaatcctaccacatagtccggaacaatacgattcatcactgcatctgccgatggacgcagggcaagctcctcacgtctgacatccagcggaatctccacgttgtggaaatctgcttttttcagtggaagcagctgcagcatctctgcttcttcctgcatcgcattgaccattgaggtataaatgatatagatttcatcaaactctccctgacggtaaccttcgagaagttcctcagagatatttcgtgcacggttcaatgtcggattctgaatcgtataatggaactgtttgttgatctcaattccacgttcttcaaaataatgtcttccgacttcaccaagcacatacagctgacgtttcgggtgctttacaagttcctcttccgcaatttttaaaatattgtggttgtaagatcctgccagtcccttatctgccgtaactaccatataagcgatccgtttttcttcttccggaatctcatctgtggacctaaaataaatactgtccagatccggcaaatgccgcagaatacggctcatctcagattgcagggtaaagaaatacggttctgtgtccgtcagcatttttttagatttctttaatttcgaagaagaaatcatgtacattgcatttgtaatctttaatgtatcattgatactcttcattcgatcctgaatttcttttgcatttgccatcgtaacacctgcttactgttctgctgcgaactctgctgcagcatctttgattttctgtctcagttcatcggataaagcttttgtctgctcaatttcttttccgatctccggatgtttcagatccatgaaatccagaatatctttctgatactgttttacctgtctggtaggtatcttatcgaatacaccgtccgttgccatgcacagggttaatacctgctcatgcatggaaagcggatgactcagcggctgcttcaacagctccatcagagcttttccgtgctgcagctgtgcttttgttgcatcatccagatcagaagcaaactgtgtgaacacttccatctcacggtactgtgccagatcgatacggatactaccggaggctttcttcattgcctttgtctgggctgcaccaccgactcgggatacggaaagtcctacgtttacggctggtctcatacctgcgttgaacaggttgctctcgaggaagatctgaccatcggtaatggaaataacgttggtaggaatatatgcggaaacatcaccggcctgtgtttcaataatcggcagtgcggtgatggaaccgccacctaacttgtcactcagatgactggaacgctcaagcagtctggagtgtaagtagaatacatcacccggataagcctcacgtcccggggaacgctcaagcagaagggaaattgcacggtatgcaaccgcatgcttggacagatcatcatatacaatgagaacatccttgcccttgtgcataaaatattctgccatagcagttcctgcatatggagctatgtactgtaaagatgccggatcactggctgtagaagatactacgatggaataatccatggcatcatgtttctttaatgtatttacaatctttgcaacggtagatgccttctgaccaatggcaacgtaaatacagattacatctttgcctctctggttgataatggtatctgttgcaatggatgtcttacctgtctgacggtcaccaatgatcaactcacgctgtccacgtccgattgggaacatggaatcaatggaaagaataccggtctccattggtgtgtctacgctttgtctgtcgatgataccaggagcttcctgctcgatcggacgataatcatcctcttttacatcaccgtttccgtcaatcggctcaccgagtgcattgattactcttcctacaaacgcatcaccgaccggaataccggcttttttcttggtacgaaccactttggttccttctttgattccggtatcacgaccaaaaagaataataccgatttcattctgtctgacatcctgaaccattcctttgactccgttttcaaaggctacgatctcgccatacattgcatgatcaattccgtatacggtaacaattccatcaccgacccagatgacctcacctgtctcacggctttgttcatcccagttgatattttcgatctcaccctgaataatggagataatatctgttgcactaatagcgcccaaaggggtcacctccctgtaagttttctttgtaactgacgcagacgtccttcatagctgtggtcatattctttatatcccaccttaacaacatagccaccgatcagcgactcatccacactctgcgtcagggtaatctcactatccggatagtttttatccagaatttttttcgcctcggcctcctcttctttgctcggagtctcggcataaatcaggtccgcacgaaccacatgatgcatctgatcccagtatttataataatattggaaaatatcctgcatctcggtcatgttaccaatcctgcacatggtcttcatgtaccggaccagcacatcttctgtcgtttccagtgcaaatacctgatcgataatttcatacttttttgctgccggtacgaccgggctcgtcagaactttctgcagttgcggtgtcataaagaaaagtttttccgctttctcgacatcctctctgctgacagacagccggtatagtaccttggcactatttactgctgcctgcgtcatgtgcttcacccgtcttcataatcttcttagcagccagcaaagcaagctctgcgatctttgcctgagcatctcttgttgccttttcctgctcatttgcaatatcactctttgctttctcaagcatatgatctgcttcggctctggttgcttccattttattgttatattcttcctgtgcacgcgtcttcgcatcgagaatgatctgatctgccttttctctggcaccctttaactggttctcatactcactcttcatctgcgctgcatcgtcctgctgtttttgggcatcctcgaactgtttgttgatcatgtcctctctctcatgaatgatattcatgaccggctgaaacaaaaacttacgaaagattgcatataaaacaagcagatttacgatcgtccacaagatatcccatggatttaaactcagcatagtttactgctcctttcttaatgtaataattacgcaggtaatcattattttaagaaaagaatgataagtaatgcaataacgaaaccgtaaatagcggttgcctcggcaagtgcacaaccaagaagtaatgctttggaaatcttaccttctgcttccggctgtcttgcgatagcgtctactgcggaacctgttgccttaccgattccaagacctgctccgatacctgttaatactgctactcctgctccgattgctacaaataatgatgctgacataatgttttctccttttcttttctcagttaattagtgtgttactccgttgcttccttgatgaacaagcctgtaaggaatacaaatacgtatgcctgaatcagtccgtcaaaaatatcaaagtaacaactgaatattgctggaagtacgggtggaaccaccatcttcagtaactccataataacgaaggaaccaagtacgtttccaaacaatcgcatacaaagtgataatggtttgatgaatatctcaagaatgttaattggaagaactacaggcatcggttccgcaaaactctttaaccagcctttggtacctttctttctcactcctgctgcttcaattaagatgatactcatcaatgcaagcgctaccgtgacattcatgtcttttgtcggcggcttgaagcctaataggccgatgaggttggcaattcctatgtagatggcaactgctgccaggtacggaatgtacgctttaccgttttctcctatcgtgtcctcaaagaatccatacagttttgaaacagcaagttcaagtactacctgcttacggcttggattctcaactttaagtcctctgacaaggatcagacacaaaagaagaatgaccgccatgatgatccatgtaacaacaaccgattcatagatcggaatgccaccaaacagcgggattgtaaagacggtatcgcaattcagctcctccatcagattctttaccaacgcatccaacagtctcacttcctttcttaacttttgaatcaaaagctattatatttgtcatattgtaaaaagtaaaacgttttttttatataaactatatgtcatatttgtatatttctcacatggtcatacactttatatataaaaagaggcgtcgtacatacattacgacgcctttgctctacccactgtggtattctacccctttcttccccaaaatgcaagcacaaaaaaactaattttcggcaaaaaactccgaaagaacttctttcagcgtatttgcagactcatgcagtctggaaacttcctcctgatccagatcgattggaaccttggtttcatagccatcgcggccaacgatacacggcagacttaacaccacgtctgagattccatactctccgtgcagcatggtcgaaatcggcagaattgatttttcatctcttatgattgcttcgcagatgcgcttaactgacatggcaattccataatatgtggctccttttttggaaataatctcataggcactctgttttacctccgcggcgatacgttccgttgcttccacatgattatagtgcccccgcatctcacagaaattgtccagcggtattccggatatattcgcactgctccatgccgcaatctcgctgtccccgtgttctcccacgataaaagcatgtacacttctgctgtccactcccagatgctgtcccagatgatacttcagtctggcagaatccagcacagttccggaaccaattacccggttttccggataaccggacagtttctgcgccgtgtaagtcagaatatctaccggatttgcaacaatcagaagaattccttcaaaatccctttttgtaatttccggaataatcgactggaaaattgcaatgtttttgtgcaccagatccagtctggtttcgtccggcttctgatttgcacctgctgtaattacaataatggctgcatccgcaatatcatcataatctccggcataaatctgcatcggtcttccaaacggaattccgtgtacgatatcttcggcttccccttctgctttctgatggtttgcatccaaaagcaccatctcggtaaataatccgctctgcatcagggcgaatgcagatgcagaaccgacaaatccacatccgataattgctacttttcctggttttaatttactcatatggttacctccttccaggcacaaaaattctctacaatatagtctgcctcttttccgtcatcatttttcggggaaatattggaatttacataaaacaccggcattccgacaccttttgcaccaccgacatcacaacggctgtcattcccgatatacagggaatgtgacacatccagcttatgccgctccaacaatatatgaaagaaacgtttgtccggttttttcgtgtgataatccgaagaaatcaaaatatcatcaaaatattttgtaatgcctaaaacattcatttcatatgcggtaaaaatgcgctgggcattcgataacagatatacttttttgtccatttttttcagactggcaagcatctgctgtgtccccggatacaaacggacataatcggtagacagcgcacggaaaaactgtccggtatgtatggcaagggtcttatcggccacgatccctttttcctgatacagtttttcaaacacttccccgatctcaatctccggagatgcctcatgcgtataatgcctgtcctcttccagcgtctttttcaacgcacgctcacagtcgctgacaagtgccgcatagcgcttctgcaattccttcggttcataaatggccccgtaatatccaaaaaacaatgccagtttctcccacagttttggaaaatcttcctctgtgtggatatccaccagtgtcccgtacagatcaaacacataattgtcgtactgcaccggcaacacggcttcctgcaaatattctcccatgttaatttctcccttttgtgatcttttacgtgcaaattataccagattttccctgtacctgtaagtggtagctacaacatttttctgcgaagtttttccagtatcttcctctcactgcgcgatacggatacctgatttttccccatgcgctttgctgtttctgcctgggaaagattgtccatatagcgaaattttatcagctgtgcctcttcctccggcagctggtcgatcgcctgtttcaatgcaatatgattcagaagcggagtttcaaaccggtgattatcctccagcttttcttccaaagtcatcacttttccgtcattttccgtcaccggtcgtgaaaaagaatccacctctcttcctgcttccattgccaccaccagatcttcaatggcaattcctgtcttttccgccagttcctgcaatgtcggctccttattttgtgtctttttcatttgttctctgacaattgctatttttcttgcatgttctttcatctggcgactcgtatgaatcataccgtcatcccgtaaaaatctccggatttcccccataataagcggaaccgcataggtagaaaaagagtaggatagcgaagtgtcaaaccggtcgatcgccttgatcagaccaatcactccgatctgtgtcagatcctgcaaatcggttccccggtttgcaaatcgtttcgccaccatataaaccagccccatattctcggttatcatctgctgcctgatcttccggtctccctgctgcgccctctggatgttctgtcgtccattttcctcttttgccggtatcttactgctcacgttccctttctatgtatttccacataaccacacgtgttccttctcctttttttgaccgtacctcaatccgatccataaatgcctccataaaggaaaagcccataccggaacgttccaattccggttttgtagtaaaaaaaggctgcaatgcctgttcaagatcttcaattccgactccgtgatcttccaccgttaccaccaattgctgaccgttttggtcacaggtcagttccacctgtttcgtttcatcttcgtatccatgaataatggcatttgtcacagcctcactcactgctgtctttacatctgcaatctgctccagcgtcggattcatatttgtcataaatgcggtcacaaccatgcgtgccaatccctcatttacggattttgcatcaaaatgaacctgcatatgattttcctgcaccattttatttttcctcctcttccaatgaaataatctgaaacaacccggatttttcaaatattttatacacccgttctcccagatttaccgctgtcacttttcctgcatgcatgtccatcgtcttttttcttcctattaatataccgattccggaactgtccataaaatcagtccccgcaaaatcaaatacaatcctgtgaacatgccagctttccgccagcagatctatttccctgctcatattgcctgccacatgatgatccacctcccgcggcatcggcacaatcatgcagtccgcttcctttcgatatgctgcttccatataaaacctcttcctttcccttacttctttataaataagcaaaaaaagacaccgacagtaacctgtactgtagtgtcttttgtaatgcaatgtgttcctttttattcctgtgcgtctacataattctgtgacgttctcgcccgctccgtatccggataattttcaattacatactgataatacggttttgcagatttcaggtccccgtttttccggtaggactgcgccagataataggcagctgatccatcctggaaatcttcctgctcatccgtaatctgttttaatgtatcgatggcgtccttatactttccacgggagtacaaactatagccttccttgtaaagctgattcagatacttatcctgtacctccccattgatatcatcatatatggttttagctttgtcggacagatacttcgtctttactttatccagtgtctttcccgcagtcgtcacatcctttgatccataataggaaacacatgcctgcaggagattttcataagtggatatctgaaccttgaccttttcgttgttggtcgtctgctcttccagctgatttttcagatcctccacctgtccttccagatctttgattgtctgtccattcgtggaaatggtatcactcgcttcaaccagttttctctgtgcatcttcttttgccttgttgcgaacgctcggcacgatcagaaatgcggtaatcgcagtacccacaatcagtccgatcacaatatataccagtgttgccccaatcgaagattccttaaaccgcttcggcatgataatggtctcatttccactttgataagaaatcagatcatcatccttcggctttttggaaggacttttttccttcagtcttgcattcacttcgcgcagataacgcagggtggttgtattatttgtatcaatctttcccgcattgcgcaaagttttttttgccagttccagcttattgtcctgcagataaagaagcgccagcagctgatgtgccttgacaagcttcggattcagcgaaagtacctttttcagctggataattgccagatcccgactgtcctgcttgcaatagtgcaatgcctggttatattttttaatcgtctgatttacggaatccaatcttccccggtcctgctggatctcatcaagataatgactggcaagattgtccttcggctgataactgcggctgatcacccattcacttaaggcatctaccacttctcctgtctcgcaataaatcaatcccagaagatttcgtgcatcaatattatatttattaaacttcagactgtttttcaggctgacaatcgctccggaaagatttctcacgcccgcctgttccagccccagattataatatgcgttggaaatgtgacgcactttcaaaaatacggaaagatctgccccgcaattcgggcagcgctttgcatttccaacctcctgtccacatttataacaaatcatttcttcctctttttcattactgtcctaactgctgaccattctgacgtacatcacgcaatatttcggtaataatatccgttacatctgtcagatcatggttataaattgcagcctcggcttcttctacttccagactcggctgaaaattcttcagctctttttcaaaattaatcatttctcctgctcctttttgcgatatacaggttctgcgttcccatgtatcttaattataatataatgcattggatatgcaagtaaatttattcgcattatttctcggaaatattacaggaactgcatctgtttacttgagagagatcatcacaaccccttcttttttcttctggaaacaaacggactcctgcagttcttttacggtaagcgtctgctggtcaatggttacaacacatccggaatacactttgcgtacgacactgatctttgcattttccccgcgtttgaccagttcttccagacgatctaccgctttttggctttcagcaatatctgcctgcgttttcattttggcacgaagaagctcagttctgcgcggatctttcgatacatcaattcctttttgcgcagccaccagttcaaactgtttcagcccagtggtaatcttcttgatcacttccccattttcttcaatggatttctgcagatccgacagttcctgccgcatctgcgcactgactccgacatgcacctgtgtctttacttccgtggaatttccgattacattcacatccattccactgattgcgtaggcatatccgccaatgatacttcccttttttccggttacataaatatgatcaaaactgatcatatgactgtctaatgcataagtcacttcaataaagccatcggctttcaccttacagtattcgaaaaattttgcgtggatattcccacctgcacgaatactggtcttgtttccaccgagaacaccgcttcgcaggacaatatcttttcccgcttcaatcacacagttctcgcagataccgtctaccgtgagacttccactcgtacttacctttgcccccggtttgattccaccgtggattacaacatctccgtgatattccacatttcctgtaccgattcccacatcaccgggaatttcataaactgcggatatccggatctttccgtttgacatttcaatctttccagacaggtctgcaatataagtacttccgtcttctgtacagtgaaatccttttccgcggagtggctgcaatggcttgccacggactgccagtatcggctttcccgaaacattcatcccgtttaccgcctcggttggtggatagtaggtggcaattgcctgaccttcttttaccatctccactgtacggatgctccagtaatctatggaaccatcctccttgacctttggttttccatccacatccggattgaaatgaagttcatagcggccgttttctgcattgaccggtggctgtccttttgcaatacatacatctctcatgtacactccgccatcgatcatctcctggatcgccgcttcgtcaattccattggttacccgctgggtgcggatataccgcaccagctctgataatgtgtatccctctccggcctccggcggctgcaatgtcaaatatgcttccatactatcctgtgaaatccgaacaaccgcacctctcattgaaatatcttccatggcattttcccctctctgctatagaaatccgaaaccatttatttcatttgtgccagccgcgcttctacctgagccatcatctgctcatactttgccagcttgtctttctcttcctgtaccttttccggttttgcgttatttaagaatttttcattggaaagcatgcccttagaacgtgcaagttccttcgtcagcttatctttttctttatgcaaacgctctttttctttttcaaaatctaccagatcctccagcggcagataaagaactgctcccggaatcacaacggaaaccgcatcctcactgataccgtttttgtctgcctgtactataatctcgctggtagaagcaagatttacatatacttccttattttcttcaaaaacagtgcgaagccctgcatcctcagatgtaatataaagctttgcctttcttgatggcggaacatccatttctgtgcggacattacggattcccttaacgagatccttacagtgctcaatggctgcttcctctgccgggaagttccactcttctttgtactccggccacttggagagcataatcgtctcttcctctgactgtaaggtacagaagatttcttccgtgataaatggcatatacggatgtaacagtttcaatgcctcggtcagtacggtctttaaggtccacagtgccgcattggcagataccggatcttcatcctttttataggtacggacttttgcgatctcaatgtaccagtcacagaactcatcccagataaaatcgtatactttctgtacggcaattccgagttcaaatttatccatattttctgtggcatcttttgcaagggtattcaccttggaaagaatccacttgtctgctgcatgtaactcatcctttgacggcgtatggagttcaaatccatccagattcatcatgataaaacgggatgcattccatactttattggcgaagttacgggatgcctccacacgctcccagtagaaccgcatgtcatttcccggtgcatttccggtaatcagtgtcagacgaagtgcatctgcgccatacttgtcaatgacttccagtggatcaataccattgcccagtgatttactcatcttgcgtccctgggagtcacgtaccagtccgtggaacagtacggtatggaacggtgccttacccatctgctcatatccggagaaaatcatacggataacccagaagaaaataatatcgtatccggttaccagcacatcgttcggatagaaataatccagatcctcggtcttttccggccagcctaacgtagagaatggccacagtgcagaagagaaccaggtatcaagcgtatccggatcctgtgtcatatgtgtacatccgcacttcggacacttgccaggattttcgatggatactaccatctcgccacagtcatcgcagtaccatgccggaatgcggtgtccccaccacagctgacggctgatacaccagtcacggatgttgtcggtccagttaaagtaggtcttgtccatacgctttggaagaagtttgatatctccgttcttcacaccttccacagccggcttgatcatctcatccatctttacaaaccactgctgcttgatcatcggctcaaccgttgtatgacagcggtcatgcacaccgacattgtgggaatgtggaacaacttttaccagaagtccctctttcttaagatcatccaccagtgctttccggcactcgtagcggtccattccggcatattttccggctttttcattcatcgttgcatcgtcgttgatgacaacaatttcttccagattatgacgctttccaacctcaaaatcgttcgggtcatgtgccggagtgatctttacgcatccggttccaaattccttgtctacataagcatctgcgatcaccggtatttcgcggtccgtcatcggaagctttaaagtctttccgacaatatctttataacgctcatcgtccgggtttactgccaccgcagtatcaccaaacagtgtctccggacgtgtggtggcaatctctacgaagcggccttcctctccaacaaccggataattgatatgccagaaaaatccatcctgctcttcatgctcaacttccgcatcggaaatggaagtcttacataccggacaccagttgacaatacgggaacctttataaatccagcccttcttatataacttggtgaatacttcctgtaccgcatgggaacatccttcatccatcgtaaagcgctcacgctgccagtctgcggaagaaccaagtttgcgcagctgctttacaatacgtccgccgtattcttttctccactcccagcacttatccaggaactcttcacgggtcaggtccgccttattgatgccctgctcttttaaactctgaatcacctttacctctgtagcgatggatgcgtgatccgtacccggctgccacagtgcattgtatccctgcattctcttgtagcggatcaggatatcctgcatggtattatccagtgcatgtcccatgtgaagctgaccggtaatatttggcggtggcatcacaatggtaaacggtttcttgctgcggtctacttctgcatgaaaatacccattgtcctcccacttcttatagagacgatcctctatatctttcggatcgtatgttttacttaattctttgctcatgtgttcctccttaatataaatgaaacgccctctgtacagaaagccttttctttttctgcacaaagggcgaaaactctcgcggtaccacctttgtaatactcatcatgtcctttaacggggacgatccgggaatgcctacagggcaatataccacattcaacattccagttccagagctaccttccacactgcatcctgtggatatcttacagccattgcaggaacattctgcacgaaaactctgccaatgctccacttcaatgaatatccttctctttcaggaattccatgtgtactcctctccatcatcacttttttatacataatttaatcttacttgcggctctcttttttgtcaagaagatttctgtgaaattcactataattcctcttctaccatgttcttttcccgatggaacatatcgtagatacatggaatgacaatcagcgtcagaacggtaccataaaccagtcctccaatcagtgtgattgccatcggacgcatcatgtcggaaccgtcaccgattccaagagccgtagtcagcattgcaagaactgtggtcagtaccgtcatcagaatcggacgaacacgggtctttccggatgaaataatcgcctcatgcttagaaacacccgcttttcttgcctgattgatataatcaatcagtacaataccgttgtttacaataagacctgccagcatgataaatccaagcattgcaaggacattgacttcctgccctgtcagaagcagagcaataaatcctccggtgaaggcaagcggaatcgagaacataatgataaacggagaaaccagtgactggaactgtaccaccatgatcagataaataaagataactgccagtatcatcatcagaaccagctggctcatggaatcactgattgtctcgtcctctccggtcatttcgatatgatagccttccggcacattcagcttatccatactcttttgaattttattgccaagcagtgtgatattgtgatcttcatccacaccacaggatactgtaatataacgtgtctgtgcatcccgtttcatggtgctgagtgttgtcgtatctttcatctcacagattttcgtaagaggaatctctttttcttttccgtctttgtctgtgtgggtaaatgtcatctgtctgatatcgtccagtttcgtatccgtctgttcctgtgtctgcacatagactttataatctttgatgtctgtggaaatcgtggttgcgctcttgctgtctgccatcttcgcactgacaagctgatatacctgtgcaaccgtgtatccgtattccgcagctttttctttatccacggaaatggtaagctgtggttccatatcttccagaccatcgtccacatccacggttccctttgtctgcttcatcacatctgccacttctttggcaagcttctgcagcgtatcaatatcatttcctttaattctgacggaaagaccgctgccgaaataactgctgtaatccatggaagaactgttggtttctactttgcagtccagatctttcgtcctgctgacaattttttcttccacatccgatgctttgactttggagtcctcatccagcaggatatacatgctgacgctgtcatttcctccacccatcagattcatcgtggaatctccaccagccatcgctccgaccgtcttgattcctttgatttttgagattctctgaatcacatcatccgatgcctgtgttaattcctcaaaggtcagtttctcaccctcttttgcagaaatcgtgacggaaagctgatttgtctccatatccatatccataaagtttaagccttttgaaagtgacagtgctgcacttccgatcagaagaaccaccgcaataatcagtaccagtggtttgaaacgcagacaccactccagcactctgccataccattcccgggcggcatcgaaccacggatgacggatatcttttgtttttctgagtgtaacagaagccatcgccgggacaaacgtcaatgccacgaccagactcgctaccagggtatatgcaatcgtcagggcaagatccacaaacagctgccgggtaattccctctgtaaaaataatcggcgcatagacgctgatcgtggtaagcgttgacgcaatgatcgcacccgtcacctgttttgatccttctaccgctgctttccggatggaatagccttctccgcgcagacgataaatattttcgatgacaacaattgagttgtccacaagcataccaataccaagcatcagtccggacatggaaataatatttaaggtaattccggtaaagtacatcagcacgattgcagcgacaacggaaagcggtatggaacatgcaatcacgattgtcggtttgatatctttcaggaacagcagcaataccaaaatagcaaggattgccccccagatcatattctgcattacagagtttacaatcatgtcaatgtatacgccctgattcatcaatacattcaggtggagcttggaatcttctttttctaacgctttgaatttatccagaatacgattcgtaacttctccggtagaatatccggtctgtttttccatcgaaagcataatgcccggattgccattaatcaccgcatacgtctcgtcggaattatccgtcactttgatttctgccacatccgaaaggcggattgtatcaattccatcaattcccatatccacaagcggcaggtcttttaattcgctgacatcctgcacggcatctcccacacgtaccagatactcagtatccccatccatggcatatcccgccggcatatcaaaattctgcgcggcaagcaggcttgtgatggtatccttgctcagcactttattcagatctgcggaatcatgtgccgtatctttggcttcatccagtttactctgtgcgctctccaaggaggaggctgcattggccagttcggtagaagaagcactgacctgaagtgccgtcatggatgcattggcatttaacgtatccaaagccgaggccaggctgacttttccgctctctaccttctgctgtgcacgttcaatggttttcattcctgtattgactttggtcaggagttttcccacttctgcggatgccgccgggagatcctcataggtatttactgtgattccaagcgaggacaacgccgaaaactgctttttcacaaccgcattaacctgtttgatctgtgcctgcatctcactgctctctgcaagctgcgggttatcttttaataccgtcacgattccggtgtaggcatccgacttcataaaggtctggatgcctgtctggatctgttccaaagaagctttctgtttttttaactctgtgagttgttttttcagatcctgttccgtcttgtagagcttcttctgctgatccatcgtctgattaatcgcgctgtttaactgctccgatccctgactgatggaagactttccactctctactttctttttgcccgcatcaatttttttctgggatttttcaaactgttcatcaatcttcttctgaatctttttatttaatgcgtctatcttgtcctgatcgagtgttacatctacgctttcttccagctgcccggtcgtagtgacagaagccactccttccagactttcaagtgccggcgcaagatcattcttcacataatcggaaagtgcgttcgcatccatgccatccttatccaccgctgcagccagcaccggcatcatgtccggattgactttcataatcataggtgttccgatggaatcatcccattgcccggatacctggtcaagactctgctggatttcgatcaccaccgaatccatatttgcattctgctcatattccagtgttacgacggaataactgttataggaaacagaactgatatttttaatgttggacgttgttgccatcgctgattcaatcggcgctgtcacatcactttccacctgttccggacttgctcccatatcggttgtgacaaccagcgcatactgaaaactcatatccggaagcagatctgtcgtcatttttgacaacgagaccgcaccgagcacgatgaccagcacaactgccacaagcacggtataaggacgtttcacactgtactttgaaatcatgttttcctcctgtaaatttttcttctgctgaataaagcagacgcattggaagtggaacacagttcccagcgcctgttttttttcattataccgataatcggttcttttttacaagaggatttccgaaagctttattttctttttagaaacaaaaaaaagacatccgtttccgaacgtctttctttcctgtactctgtccgttattttctgactgctttatgcgttctcctccagtccatcctcttcatccgaaatagctgcagatgccccggatactgctgcaatcactgcgatcaatgccccaagtaccgcaatcccgataatcgcaatcagaaaaataaataaccccgttgctgacatgattccatctccttttgtaattaatccccaaatccttttcacctgtcttatcctttaagatacccggataagtctcaaagaatacaatttcttttttttattttatcacagaaccactgtcctcacaatgttattttactttaattttcatggaaactgtctttgtctttccgttcttcagtgttacttttgctttgatcgtgacggttcccttcttctttgctgtaatctttccgtttttatctactgctgcaacagactttttaccagatgtatatgtaatcttttttacattatccagatccagcttactgcttaactgtatctttgtattctttcccgctttgatggaagctgtcgtcttttttacggcaaccgtttttaaaaccgctttttccacattttttatttctgctgcagaaagcatccgataatccgaacctgcggcaagattcacatgtaatgtgccatcttttccaacggtatacgtctttgcatttaccagcttatacgctccggttttcttatccgcaacaacgacactcagtttgttacctgcggttaagtcttttgcatctgcggttactgtatatctgatatttccttctttatcggtaacatttgcagtaattgccacatggtctgttccggcagcttccacgatcctgctcaccatatctgcagaaatctctgccttggtacctgtcacttctgcacttgcttccgttacttttccagccgtatcttttgtcacggtaaccgttacttctgctttctccccagaagcagtcgttgccgttacgttctttgattcggttgtctgctctggcttgtcatccttctttgtatcatcagatggagtgacggttgcagtgctgccggaggatgagccaccaaaggatgagctgccggaagtatttgtatcatcctttccttccgaagatgatgcatccttatgcagatacagcacatccactgctccccatccgccatcttcatgttctacgcatacacgaagttttacgctctttgtcttatccagtgtaaaagttaccttcggtgtatgccagtctccccatgcggtcattgctgtggcttcgccggtaaataatacactgtcatcttctgcatttaatatctgcatggttacatttgactgtgccccctgggcatatgcttccaatgtataggttcctttttccagcgtaattgctttcttatatgtaacagaaccatttgctgcggatgctccgtaccagcccatactgttttttccgctctttgcattctctgcggaaggaattcccttgaacgtggctccgtctacggtaaagtattctccactgtcaaattcaaccgcttctttatttgtaatcagatttgcatattttacctgtaaagtaagtgtaacatctacactggtttttcctttgtaagcacctcttgtaatttctttgctcaaagaaaccgtgccaggaatctgataagttccagtttttgatatctctgccttttttacagctgcctcatcccaggtaactgcctctgctaccggtgttttgttatcggaataagtcacttccacggaatccggaagtgtaaaatcactgcctgcagtaatcgtctgtgtcagtgcagaatcaaatccttctacacttactagattcgagacagcacccgtttttacataattccatacatgaagtgcaggagttgcagtgccatccggataaaacatggcttcattgtcaactgcggaaccgccataccatttgcctgcatctttcgaatcatattcgttggcatagcctgaagcccatccgcttccgtatttttcccacttttcctgattttcctttacctgtgcattatatgcatctccggtaagtcctttggtatttccgacggtcagccatgccggctcccagtaatatacgcccagtccgccagcttcatttaccgtattgatcagattgcggatcgccgttgcctgcccctgctcggtaaacggctccgttgtgtcagctccgttatcattatttccaacacgcactgtattggcatgtccgtcactgtcttctaacgtataagcataactggtttccgcaaccatcacatctttatgatatgtattctttaccgtctcaaactgctgttttaagttatctaatgttccgtgccagtatgggtaataactggtggcgagaatatcatacgcaacgttgttgtcctgcagatttcctgcccatgttaccatggttcctttatgtgggctttccacatggatgacgactttgacatccggattgtacgtttttacaccggctgcgccagctgaaaataatacacacatattgctgacatttgtctcaccgataaatccacccgttgtctcatttccaacctgcaccatatccacaacatcttttgacggatcaatggtatttaaggattctgtgatataagtatttaatgcctcttttttctgttcaagggtgtaacctttccatgctttcggttcctgctgcttgcccggatctgtccacagatcggagcagtggaagtcaactaacattttcaatccggcattgcggcatgcatctgcaaattcctttgcttttgccacatcattgtttcctccgccatagccgttgccattggcatcatacggatcattccatacacggacacgaatgtgattgatgccctgctctttgataaacctgcagatatcatcaagcgttgtcagttcgtttccgtcatagtcacggtataccacaccactctgtaattcagagatcatggaggagatatccattcccatgataaaatcagaagacaaattgtttacttttgttacatcgatcggtgcatcttttacactgttggatgcctcgttcactgtaatttctattttctttatcacaatatccttccactctgcgtcctgaagttttgcctgaatttcgttggttccaagcgttcctaaagttgtctgcaaggtgagtgaataaccattactttcatcataatttataaattcaccggaactgtttgttgtattattccaccagtacagatgcagccctgctgcttctaaatcggtgatttcggtctgtccctttttcagtacggctgtcagactaactgtatcacctgcttctactgtagtgttatctgctgtgatctgcagattgtattcagtggaattgtcatcatcatctgcctgatcttccatattcaatccagcttctgacagatttgtatatacggtttcatcttttactgcataagcgctctccgttccagaaacaaaattcgcataatcgctttggttattatactgactgtcatattgtaccagtatattgtcatctcctgttccattctgataaatggtaaatccatcatctgcctctgcatccaaaattttaatagttacactataccagttttcatttccatcaacggctttcataacggcaagatcatgattccatccaaattcagaagtcacttctacatcttctgcaaatgaaattccagtccaactccatatattcacatacaacggctcctgactttcattgtaataatacaatgtaaaactgctattctccgctgcctgtacgctctcctttccggcattccacaccccaagctgtgtaatcaccatagcaagtgccagaaaaaaactgagcactctcctgttccaatgttttttctctttcatacacgatcctccctctttggacacaaacacgatagttctgatatcctctcccttatcaccagacctatcgtgttgcgcaaccgtttgttttgttgatatgtccactataccacttgcgcaaccgtttattcaattgacggaaattccaagtttttcttatgcattttatacacttttcacatacatttccgttgcatgaaagagattttgcacaaaacaaaaaaggtgcaatgttgtaaatcactgcgccttttttgatattttatgcaattatacctgcatttttattctttattctgttttatgcgtttttttataaggtatttgcttataattctttcaactaccgtaaacacttttaccaatgtctttgcgatgctttattttaatttttcaattatggtttctaattcagctgcttccaattctgttgcatccataatctgttctaacgagtaccctttcttatgcatatttaaaattactttttcaatttctctttgcttgccctcggcaattccagcttctcgcccctcggcaattccggcttctttaatgccctgactcaaattacacataatactcacttcctccttaaaattttcttccattggaatatgatattcctgttccataattttcattttttgctgttgtgataattcattagaaaacatggcacataacagtctatgcagcacatattcattatgactctccggaagcgcattcgtcaagccgatcataacgatatttaccagattcaaatttcctttccaattatgctttccgagtaaatcttcttttgttaaataaatatgacacatactgttttccggcatattcatgcaaacccatatactatagactgtctttatatcattataatttgattttacaaaatcccgttccttctgtgaagaaatcagtctgcttacataaaaaatagcgcggtttaaaatctgataggaaccgggttcatctttttgggcttccacattgataatcatctgtgccaacccgtttctcattcgcacataaaaaataatgtcaaaacgaaccagtccttcatttttttctccggtttctgtatttagtcctacaatccttttcccctccacattcctgtccttattggtcagtccagacgcaaccggtactttgctgatatatggatctccttctatcagggaagctactttttcgatttccatcccttgaaattcttccactgttctaactaaaatgtgagccaatacatacttttgtgctaacagacgctttgcgctttcatcatactgtgcctcgctatcagctgcctgtatggcattctttatctctgtgttcaaataaaacctcctcttacataaaaatccccgtcaaaaaatctccccaaaagaacgtatgtgattttattgtaaaggatattgattctgatagcaaattaaatttttataaatccatttttctctctattacattgcccctaaaaaatttcagggaaccccctatacttttgagatccccttcaaaaaataataaattttttctgcaagtaaaaaactgcccaccggttatggatggacagttttcactgaatcttgattcaattattgtacagtaaatgtaacggtatatggaattggatcactcttgcacgtgtactcgtcccattcaccatcacttttccgaacactgcagccaaaataataattaaatttaaccacatatgttctagctttcaagtcttccggaacttcaaatgtaaagaaaacattttcttcttctttcgaatattccaaagaagtatatgcaccattcagactatcattcagtgcagaatcatcacaggcaaatttgaaacttccatgttcaccgttattttccggcaaaccatagcatgctgttttcagtccatccaacggaatacgaattaaagatgttgttttcacattgtcaaacttaaattcttttttaccatcggcttctgcaagacaaacagtttcttttccacctgttgttgtaactgttgtacttccgtaatactcatctacaccaataattctcttatatacaacatactctgtatcttctttaagaccggacatttcatagcatccaaaatcatccgactcatttccttgtacccactgattctctgttatagcggaaattgctgtaccgctagtaacacaagcatattcataagttggctcaactgctaccaccagagaatgtttcaaaatatgtttgatttcaggcgcagatacctgaatttcagattctttacatataaaagtcacattaccgtatatctcatatctttcatcattctctccataaattgtaacccacatagatgcaaacaattttggatcatttttctctattgtctcattataagaaacttcaaagtctatatctttaagttcctcatcttcattaaattttttctgaatttcatcaaacaaaactttctgacaaatcattgggttctgtaatgctgatatagatgcagacaattcattcttttcaatattttttacaacattctgtgccttatccatttttccaacagaaggagtcggagttacacttcccccggaagatgaacttccccctgttgccccaccaccattattggcatctgtattgtcttctacatccgtaacttttcctgcattatctacttttgaagtggtatcctttgccacgtccttgcttcctgccggagtcgtaaccgttactgcctgtgttgtctcattctttacggtgacttctgctttatcagatgtggtctctaccttacttccctctgcacctttggtcaggttcagtgcgatcggcgctgctgcctttacctctaccggtgtactggaagttacatttgcacctgccgctttttcatttacggtaacaggtactgctgcggttgtctttccttctacagtcacattcaccggagcatcaatcgtaatgccggaaagggttccatctaccaccagttttacatttccctttgatccggaaaccataatttttgcaacggtagcaccggtttcaacaatcacacgtgcatcaccggttgcactgaccgtaataacatttccttttgcattctcgcggtaggtattcggcttgattgcctgaatatcaatagacttgaattttccgttattcacaacatccgcattcggcgcgttgatcaccagatccaccttactgtaattgccctgcggtaccgtaaatgtaacagctccctgtgtcgcaactgtgatctttgtaacatttttgtttttcagagccttttccagttcgctctgagaaccaacggtcaagctggtaacttttgctgttttcttaaccgcaaccttgcaagtgagtttggttgtcttgccattttttgttgttaccttacaggtaacgacagcatttccggcttttactgcctttactactccctttttggaaacggttgcaatggatttcttattgctggaccacttcaatttggcctttttccctgcattctttactttcagggtctttttctgtcccacctgaagtgtcattgtctttgcatttaatcttgtttttttggttgctgcatatgccgctgatggctgatagatcgtgatgatcatcgcaaatgccagtacaaatgcaagcagttttttcatttgtttcatagtcatcctcctgacaatgattcatatcctttgaaattcagatatattattttactgtaaatgaagcttctccatccggaattccttctgcggtaacgctcaccttatgctctcctgcggaaagtcctgtagcatccacccagataacaaaaaaaccatctccacttaagaaagcatccttaggttttacttctgtaccatctactttaatcacaaaatcttttccatccagctttggtgtacaaaatacatacaatataccatcggatacccaaggttccccatcttcaccctctggaaacattccatcaatctttaatgcagtaaatttaaaggattttgtcacggtcttatacccttttttctggatagcaaaagtatgttttccatctgtaagtttctttgtaagtgtaacataagaaactacacgctctccatccttatctgtccatgtactgtaattctttttcccgagtttctttccatccagtacataagttgcgcccttgatttcctctcccggataagaaatagtttctccaccagtgaatacactaatatcctttgctgcaattccaagtgattttgctgcttttacggtaactttacatgaatatgcagcttttgtctttgtatcctttgctgtaacagtacaggtgcctttctttacaccctttaccagtccctttttatcaacagtggcaatcttcttatcggaagttttccaggttacggattttactcctttcacagtcagtgaaactgtctctgtttcataaatagaaaccgatttcttgttcagttttcccgcagcctgcaccggtgttaccatagcacatgttaaaaccattgccaatgctaaaaccattaccaatgcttttttcagcttgttcataatcatttcctccttattttaaataatattttttacatattgattctaccccccaccgaaaagatatgtcaatacgaaattctttttcatccagaagcaaatattatgtatcattactgtgctctgatattttctacccataatcccttctctggcttctggaatacgaattccgtgaaaaatttagacatatagaggaaaatttttatattatgtccccattttctcgtctgtccggacatataccaaaaaaatatttgttatgtcccatgtaaatgtcataataggacatttttaccacctttacgtctatatgtcccatttgactgtttcagaaggacttttttgttatcgttttgtctatatgtcccatgcttctgccatagcaggacattttttcactctcctgtctatatgtcccactttccttattcactgggatatctttcgacctttatcctttatatgtcccgtctggttctttcagcaggtttttatgtagaacagaaatgtttcgcaaagggaaatccgtatatctgttggtttcaataaccaaaactccgggaaatacacaactcaatgtattaccgcctccgtcgtcttttgctttctggcatcatccgcaatctgttttcctgtcgcatccatatgataatttttcttcatgatcagcttcgagatgggcacaatcttgtaaccctgttcctctaaattggtcagcatggcatccaatgcatccgctgtatactttgctccattgtgacagaggataatggctcccggtgcaagtgctttatggttgcaaaccgtcgtgataatagaatccacaccatagttcttccagtccagactatccactgaccactgaatcggataataatgcatggcgtacgccgtcttgatcacatcattgtcgtaagccccataaggcggccgaaacagatacatctcataaccggtcagtttttttaccttatcatgcacagtttttaattcactgtctttttcctcctgggaaattgtcgtcatgtcataatgatgctcactgtggtttcccagatcatgccctctttttaccagctctttcacacaatccgggttatcttctacccagcctccggtcataaaaaatgtcacctttactttatgtttatccaaaacatccatgatacgcggaaaatcttctgctccccatgcagcatcgaagctgagtgctactttcttttctgttgtgtctacacagtaaatcggaagttcacgatccccgaccttagcacttgtaatcactgcagatgtcgcctgatacgagacaaacatcagacagcaaataagagccatgacaagaaaaccgtttccgatcttcctgcatgactctttttttaattcacgatgtatttttttgaacataataactccatcaaatgtctttgtagagtatatgtaccattccaaaaatttagacgcaatttatgcctgcagctcatccgctctctgaatgaaatcaatcaccacaagaattgactgcagtgctgctttctctgcaaatgttgcataatccatagaagcaccctctccatccgaaatggaacgtaaaattgcaaatggaactttatttacataacagacatgtccgatagatccgccttccatctcacaggcaatcgcatcaaaccgctcatgaatctttgtcttctgctccggtgtgctgacaaacagatcccctgtggcaatcgttccgacatgatagtgaattcctttttctgccaggcagctgcccagcagtctgcacattttttcatctgtcggcagatacacttcgttgataccggaaagaagtccaaccggatctcccagaggtgtcgtattcatatcgtgctgcactaccttatctgccacagcaacatccattacgccaagttctttgcaaagcgtaccacccacaccgatattgatcacataatccacatgaaactccagaatcattgcctccgcacagatcgcggcaaacaccttgccgattccacacactgctgcaaccacttctttgtccccaatggttccacacacataggtgacaccactgtattctttcgtgctgatatcactcatggatgctttcaggttatccacctcaatctgcatcgcaccaattactccgattctcatgtatcttttcctcctgcaatctgttttattccggatatgtaaaatccatatttgtctgttcttccagcacagcaagataggttgccgcttctgcctttgccgctgcgagagataaattttcataatgtccgcactcaattgcagacttaccgaatacctctcctttatgatcataaatctgtctcaaaacctcttttgtcatagcaaacacttctttcggacttctgctgttacgaaccagcagataaaatccggtctgacatcccatcggtccaaaataaacaacttcatttcccatctcggaattgcgaatataggtagcaaacatatgctccagagaatgcattgttgcattgtccatataatctcctgcgttcggcttgcgcgtacgcagatcataggtaatcacatccccatcttcacgggaaatataaaatcccggcatcagaagattgtgattgattgtaaaactcttaattcgattcattttgtgcctcctgcaaaaaactactatttcttgatcagagttcccataccaccggtaatctctcctgcttctttatttaatttggttacaagaacagagcggatcgcagactctccaatgaagtcaattgcagcttcaatcttaggtgccatggttccttctccgaattctcctgccgcaagatatttctttgcatcggcaagagaaagggtatccagctttacctcgtcttctttgccataattcaggcaaaccttatctacactcgtaaggatcaccagcatatcagcatccagaagttctgcaagctttccggctgcaagatccttctcaatgacagcactggctccctgcagacggttgttctgtgccagaaccgggattccgcctccaccacaggcaatgacaacctgatcggcatcggacagtgcggaaattgcatcaatttccacgatatccattggctttggagatgccacaatacggcggtatccgccttccacctctgtcacatgattccccttcttttcttcttcctctgcttcttcttttgtcatcacacgaccaatcactttggttggatgataaaatgcctcatcatacggatcaacgacaacctgtgtcagaaccgtagaaactgtcttatagattccgcggtttaataactcggtacgaatggcattctgcagatcatatccgatatatccctggctcatcgcagagcagacagatgtcggagttgctgtatattccggatacagacggcagaattcgttcattgccgtatggatcatgccaacctgcggtccattgctgtgtgtaataaccacctgataatcttcgcggataaaatccgcaactgcttttgcagtacgcgcagctgccttctgctgttccggcagtgtacttccaagagcttcatgtcccaatgcgattacaattcttttctttttcatacatcctcctaactctccaaccccggcttatgcttccaggaatctttttctggagataaaattatacgtagtaactaacatggtggagaatatttttgctactgcataaaacattcctaaatgttctacggcaaaccacatgatcatctggttcatcacaagcccgatcatactgagtgccacaaaaataaccatctcctgtgccttcgtcatgtcttcctttccaataaaaacaaaacgcatgctcaggatataattcacaataacggatacggtaaacgacacggcactggatgcaaaataatgcatgatatgtgtctctgtcaaaaagatcatcagtccataatcaatgccaaagcacaatccaccgaccgcaccaaacttacagaactgaatgaccagatcttttatcctattcatttttgtctgactcctgtttctaaaactgcaactaccccatagcattgtctgctgccacaggcagtgttgctttaaaatacaaaatagattgcccgaattatgttcggacaatctattatagcgcatcttatgcaatttgtcattaattatttgatccaccaaatccatcgaagaaaccggagttgccggaattatcggaattttccgagtttctggaattgccggagttaccggaatcctgtgagttccgagaatcattggaattatcggaactgctctcggatacaaaatcggactgtgctgcaagtgtcacggtaatggatttttccttgtagccatttcccagccgttccattgtcatttttacttcatcccctgatttgtgggatgcgatcagctgtttcagctgcgtcatacctgtaattgtctgaccgtcaaattctgtaataatatcgccctgacgaagtcctgctttttctgccggtgatccggaaacaacctgatatacatatacaccctgcggcatgttataagcactggcaacactggaggaaatatcctgtccctgaataccgaggaatgcagcctttgactgatctacctgtcctttttcaatcagctgttcaacgatcggcatggcatctgacatcgggattgcataaccaaatccttctacactcgtatcggaatattttgcagagttgataccaacaacctctccgcttgcattcagcagcgcaccaccgctgttgccagggttaattgctgcattggtctggatcatgttgttattgaccaccgtctctccggtctgctcatcctgcacggtaacggttcgtcccagcgcactgataataccgttggtaacggactgtccataaccaagtgcattaccgatggcgataacgccctgaccaacctccagcgtttcggaatcctcgtttgccgaagctaccttgatctcttttaatgtagaatctttaatatcactcagcggtactttaaccactgccagatcatccgaagcatcggtgccctgtaccttacattctacggtttcgttatccacaaactgcactttcagtgaatcggcatctgcgactacgtggttgtttgttgcaatgtaaagatatttactgtcctgtttgataataataccggaccctgcactctcactctgctgctgctgtgtcccccagaatgtctgataggatactgttccggtatttgtaattgccacaatactcggcattgcctcttttgcgattgcggaaacatcggaaagatccgctgcattgccggtactcgtctggctgactttcgcggaagaagaactctttgaactgcttacattctgtccggaaactcccagcgctttggttcctacatagctgaccccggtaaatacacctccggctaccagaccaaagaccagagcaactgccgcacacttaccaatggtagctccaaatccggacctgcgacgcggtttccggggtgccgagcctccggtcggctgctgatacggattgtacgcattgtatgatgtattctggtatgtctgtccctgactgttactattgtacggattgtatccattctgattattttgtgtactctgattctgattttgattcatattattataatagttgttatccataatgaaaaactcctttcctgttttctaaggagaattctacctgtcaactgtgttcaaattgtgacaaagttctgtaaattttgtaaatccctgttaaattgcaatgccatttttctttaacagttctctggcagactctaccgaatcagttccgagcgcatttttcaccggtgcaaattccttttcccgctcaacctcaaacggaagacaattatccatcatatacaccatatccagtatgagtgtttcaaatttgtaggcattcggctccttcggtttctgcagctgaccgctttcatccagatacggaaccttcttctctacaatatgcatcggaagatttgtttttacaatctccatcagcttatccacacggaacagataatttaaaatcacaccgaacccgtaaagcagcgaaccattttcattgacagcctctgccatctccggtgtcagttcatagtattcgacaatcgatggttttccatcttccagacacattgcacccacacgttcatacggagaaaccttacgcacgactttcgaaccacacacacatccagacaaaatcgttgccccgacaaacaccggatccgcaatcctctgcaatacattgtccacggcaaaaacattcagccattcaattccacgtgtccggatatcttcatccagatgtgcccgaagcatggatttaaaccatccaccgtttccattcggagacatcgcgagagaatcctccgattccatcagtatgtttccatcaaaatcgaccgccggaaccatttcctgcacaaaaaatttcacataactgctgtcatatccgaaaaaatcatgttcttcaaaaaacgcccgtgtctgtgcatcgtttttttcactggtcataatataaagcggaatccacacgcctgcctcatgttttacctgcatcagattttttatcagctgttcaaaaatatagagtgttttcgtcactccgatattaaacatgccttttgccttgtcaaatcccagccgggtaccctgtcctcccgccagaagaatcgcaccgacttttccttcccgaagtgctttcagtcccgtttcccgatacagatcttccttctttcggatttcagaaagttcggtcgcctgcagcggtgcaaacgttcctctttgctgttttttccgatgaatcagttccagacaggaccagtccatttcctccagctgtttttccagtttctccggcacctgtgcatctgtcagtttctgtaaatatttctgcttatactccataatattgttctttacctgttcgttcatggaaacattctcctttatctttattgactttcctctccaatgacaacagtagaccaatcatgccgattggtctactcttattccccaattgattactgtacatttgttccgccagtagtttctgatcccttctggatctcatccgtgcctgtggcacctactgtctcgttataatccgatgtattaatctttgcagaatctgccgtgattccggttgtatttacaatcgtttcagagattgcctgcaccgtctgtgatggtgtatacgcggcatcatcaaacatgtattcatgcagtttttttacattcgtcacaagatctgccggaattaccgtatctccacatctcggcatgtttttcgtagtcagatctgttggaaaaccagtggtgctgttgattttgtacttggttacatctttcgccagactcaccatctgatccagcgaaagtgttgtggaaatatcatctaccacactgttacagattttgacaagtgttgccggatttgctttctttgctttctccaacattgcctgcagcacaattctctgacgggatgcacgtttaaaatcatctccggaaagttttcggattctggcatatgtggttgcctgtgttccatccaaatgtaccagaccgtactgtgtcacattcggggtattctttccggttacgccgtccacatctttcttgtacttgttgatctggttcatctcgccctgggtaatattcagatccagtcctcccagatcatcaatcacttctacgacagctgcccagtccacacacacatattccttgatatccagatccagattggaatttaacatctgaaccgcctgttttgccccgcctctggcataagcattgttacacttgaaataagtgccgcctccgactgacagaaatgtatcacggtataccgataccagtttgacattttttgtcttattatcaatacttgcaatcatgacaacatcggaatttccctcttggtagttatttgcactccggttatccagaccaaacactgcaatattggtatatccttccaaagactccaaggtatctttgctgagatcatcattaattcctgcctctgtctcactcatattttcatatttcacacgatttaccatgccaataaaatacgcagcgacaagcaggattgcgagaagcagaatttcaaatacaaacaatacaatctttctgctcttctttttctttcttctcttttttcttcttctattatctgccatttttttaatccttttgcctattgtgtatatacagccatgcgtctgcataactgacgcggtcctgttccgacatggaagtatatttctccaggtcgagattggtcagccgcatctgcgcgttcccacactgatgacattcgacatcttttcgtctggaaaccatacggagccatccacattgcggacaaatgtatattttcatcataactgtctaccgattattcaaagtgctttaacacttctgcttttaattcttccagcatctgatctgcaccatccagggtatctcccttaacaccgacataaaatttaatcttcggttctgttccggatggacgtacacagcaccatgcattatcggataactcataatacaggacattggaagacggaagtccggtagcagtcacctccccggtctttaaatccttacgggtgtctgccttataatcgcggactgcaagtacatcaaacgctccaagctttgccggagtactctgtcttgcccgatccataatctgctgaatctgtgcggcaccatcgattcccttaagtgtcatggttgcgattccctcacggtaatatccgtacttttcgtacatatcgatcatgccatcccagagtgtctttccctgtgatttataaaaagcagcaacctcacacaacatacatacagctgccggagcatccttatctcttgcataagtgccaggaagacatccgtaactttcttcaaatccgaacacataattcttttctccggatttttcatatttcagcatctgctcaccaatatacttaaatccggtcagtacttctaccagctccacatcatatgcttttgcgattgcttttgccatatcggtagaaacgatagattctaccagtaccggattctccggcatagaattgtttgcacgtttctgtcccagaatatattctgcgatcagcatggctgacatatttccggtaaaggttacatactccccgctctttgtatccttacagtatactccaagacgatctgcatccggatccgttgccagaaccagatctgcatccttttcctttgcaagcttaagtgccagttcccatgcatccggattctccgggttcggatacggtgcggtcgggaaatggccatccgcaactgcctgctgtggctcaatgtatacattttcaaatcccagatcactcagcacacgcttaaccgggccaagaccggttccatgcaatggtgtataaacaatcttgatatcctttgccatctttttgatgatctccggatgaatggataaatttctcagttctgcaaaataggattcatccacgtcgtcgctgatgatctgatacagcccttctgcctgtgctttttccttctccatggtctttaccatgtcaaaagaagttacttttgctacttccgccataataccggtatcatgtggcggtgttacctgcgcgccgtcttcccagtatactttatacccgttatattctctcgggttatggcttgcggtaataacaatacctgcaatacatccgagtgtccggacagcaaatgaaagttccggaaccggacgcagactcttgaacacatatgttttgattccgtttgctgcaagacaaagtgctgctgcatcggtaaattcatctgccatcagacgggaatcgtgtgcgattgccacacctttctcctgtcctccctgtgccagaatataatttgccagtccctgtgttgcctgacgtactgtatagatattcatacggttggttcccgcaccgattactccacgtaatcctgccgttccaaactccagcgtacgataaaagcgatcctcgatctccttatcatctcctgcaattgccttcagttctgctttcgtctgctcatcgaaatacgggtcattacaccatttttcatattcctgtctgtaatccattattttcctatcctcctgatctgcactccttgcgatacataccttatgcttcgcccaagatttttaaattctctccacttgcaatttttcccaaaaaacaattgccgtatgtcattttatcacactcttggttttttgaaaagattttcgcagaaatattagaattccttaagaaactcctccagttccgttttggcctgctcataggaacgaaaaacaattccatggataccacatttttttgctccttctatatttaccggacgatcgtcaataaatacgctttcttcaggttctaaccagtattcatcacacagatattcgtagatctctgggtccggcttcattttttttatcttataggaaaaaacaaccccgtccataagcggcagaaatttcagtttatcttctgtgtgattcagcatgttttccccataattggagagaatgtacacatgatatccttttgctttcaaatcgagaatccattccagggcataggggaatagttccacagtatttcctatcgtattgtgaatttttgtgatttcttctgccagttccggtgcccccgcaataaatttctgtaaaaattcatccggtgttccaagtccctgatccgacgcatcccaaagtggattttcaaacatcgcgtcatttattttcttctggttttctttgctgatcccaagactctccatgtatgcatccggctcataggaaactaaaacttttcccacatcaaagataatatttctgatcatgttgtgctcctttcttttatcggctttcctttatggttgtatcataacacaaaaacgccgcatcgtatactctggtatcgacacggcgtctaatcgtcatattctagcaatagatctgaaatgttgagttctcctcctttcccacactgagcatctgcatctgctgatccagcatgcctgcaaacgatgccttcttctgcttcatctgggattccccatgattctcacgtggagactgataggtaatcgcaatgatgcttcctacgggtacaattgtctgatatctgtccttgattgctgcggtaacgcgcctcccttccatgattggcgttctttttgtttacctacattatttatatcggacatctttaccatttcttaactatttttctgaaaatttatccatttttctttcaaacaacattttctgacaaaaaaagagcggaatcgcaatgactccgcccttactggctgacaattattttgttgtataatatccactatatacgatctcgtaatgatcaaaatttggatgagaactttttgaaacataaaattccggtgttgtttttgtttctttcttatccagataaattgatccattatttaagtctataatatttccacttgcatcatagctgagaatataaacctctccatatacatactggcttgttttgtttacttcctttaatttaaaagtaatacgtgtatcagatgcctgttcatctgtgacggtaacagagagtttatcttttccaagtaccttatatttctgatccggatttctgtcaaatcccgtaattttcacactggactgcgagatatcaacatctgctgctgaagctacataaatgcgctcatatgccgtcttcccactcataacacggtagaccttttcctcttttgccgcaagttctgatccggaactgtccttcagcgaatactttaccgcaattcggtcaaacgttgcctttgtgttgtttttcagactgatgagaatataatttccatccagtttctgaagcttaaggtcaaacttcggctccgcaaccgttacttttatctttaaagactgcgtatgtccgtaataatctttcccttttatagttacaaccgaagttcctgctttctttgcagaaatggtatactgctttttcgatttattggcttttactgttgcaactgctttcttggtgcttgacgcactacttaaagatttcacaccggtaagataccaggtataggtttctcccttataaagtgttaagctctcattctttgtggctgcctccacagatgccggtgtcaccagcgccagaatcatggcaaaagccagacatgccgtaattaccctcttcattacttttttcattctttcaatttctcctttcaatcttttcatggatttacgcaaacggtgcaggcaaatgttttcccgtttactttcaatgttactttggctgtgccggtaccctttgccgtcactttgccactggcatttactaccgcaaccttcgtgttgctgctggaccaggtaattcctttgctttgtccggtcactttaaacgtgccggtcctgcctttggaaagaaccatggttacccggttcaccgcaagtcccgggatggttgttgtagtatatgttttatctgcattcgctgaagtttccagcgttgatgctgtatattttttaccggcgatcacgacagaattttccatgtgttttttgccgttgaccacttttgcggatatgccatagtgcttcataatcaactgataagcttcacaaaaccccttataatttgccttgccctgctcgagtgctttctgtgccagaaccgatgttccattcggggaaacattctgctgcatccactgctgggcggcaactgccttttcataatcgctcatcccggaggtcacatactgattccagataatatcaagcacgtttttctgggaacgcgcaatcaccgtatagggatatgtataagtttttttgccaatggttgccgttatttttacagttccggcttttttcgccgtcagccttccatccgcatctaccgataccacactgctatttgaacttttccagacgggtgccacagaagcattcaatacgacaatggatcggctctctcccacatacagtttactataccctgcctgtatttgtaaagatgtctgactgctataatgaatttcgtttgctttcgcatacgtttccgccgcagaaccatacggagtaactatcgtaagccttgccttgttacatcctgcaaatgcatctattccaatcgtttttacgctggccggaatctcaatttggtacaaatccgtctgattctgaaacgcctgtgtttcaatcgtggtatatcctgatggaatctttaccgtctgcaaatttgtcagaatcagctggccaagattcgttccgatgttagtaactacgtaggaattacattttgcaggaaaggtaactgtgcttttttctcccgtatacatataaatggaacagccttttttcgttgttgcaccttttggaatctgatagacaaatcctgccgcatcctgcgcatatgcagttccatccatatctttgacaatctctgcagcctctgcgatatatggactccccgccagcagcacggtaactgccaggaacatccccgcgatctgccggatactctttttcttagctgtttgttctcggaacttcatatcttttcctcactgtaaatttccactactgtacgatattatccggaatctccagatcggcatctgtcaggatctgtccctcaacgactttattgacaagctgctctgcatattttacctgcacctcatccggatacatgacatagcttcgtttcgtaggcatggagtaggtcgtcgatgatccgccttttcctgtaactgcataagactttacattccaggaagccagatctgacaactgcatttttaccaatgcagaaatatcctctgaactcatactcgtcgtaaacatcccggacatactatccataattgctgaatagttgctaagcaccgttgttccggaagaaattttcttaatcagtgcctcaattgcctgcatctgatgacgtcctctggaattatccccatctgcaaaagattttctctcccgcacgtaggaaagcgccaccgtaccatttaactgattggttccctgattgatataaaatccaccttcacttgtccggaaggctttctccgactctacggtaattcctccgactgcatctactaatgtcttaaatccattaaaattaatctgcacataataatccacatgctcatcatacagatttccaagtgtggccatagaacagtctattccatacattccacaatgggtcagtttatcttttgcacctgctgatgctgccgtatccacgtagtaatctctcggtgtattaattagaagcacctgcttcgtggacggattgacaactgccagaatattgacatcactgcggctggtggtaagagtaagggttctggtatcggaaccactgatataaatgacaaacggatctgttgtaatggatttttctgccgtctgtgaatcctccgtcaccaccgtttcttcctcatgatcatacagggtacgcgttctggaagaaaatgtttcatacccatcctgtgcctctaccacgtctacatatgccacattcataagcatagcatctgcatttccttcgtataatgcctgcaccatgtcgagaatattatcatacacctgcgtgtggatctgtgtcccgacagtttcattgatcttttcgattgccttttgggtatgttcgtaatcgtatttttcggtaatcgcaaacacatagtctttcgcatccatcagtgtctgtgccggatcatccgtcatcacataggcggatacggtatcggtggtctttacatttccggcaatattatcgagcgtatttccggcctttacaagcatgtaggaaccacctgcacatacaaccatacatacaagggaaagaatcactccaattgcacgtctgacatagcatcctgtctttttctttccctttttctttttgccaaaataaaacagacaatattctataataagtaacagcagaaaaattaatccaagcaggatcacatacagcgttggaacaatattcagccacaaaacaactccgaccgttgccatgctcagtaacaattggatgatcagaattactccggctgtgattttccacttgcttttctttttatcttttgtttccatgtactttctccgtttttaatatcttcactataattctttaaaattttagcgactaataattataattaacagcaactccccaatttctaaaaatgccccctatattcctttttcattttttagaaatattttcgtataccattaatcgtatagtatatcatataataaaatgctttcattcggttaaaaccaatgtaacgatatactccatactgcattcttgccgattttaatttatttcgcgacttaccgccttcactcattctacattttactaatggttcattcactccgatggcatttccatatttttttaaaattttaagccacataatataatcctcatgcaattcatcatggcacatataaaactcacgtgcaacttctgtcttcagaatcacagaagaacacggaatacaatttgtctttaacagtgcttgatactgtatgcactcagggatctcaataattcgatctaaagtttttccatcagcccttaccagctcacgtgctgtagcacataatactgccttagatgcttcaagtgcctgtagctgtttttcaatcttttcattctcccaccagtcatctgcatccaaaaaggcgatatactcaccgtttgccttccttattccattatttctcgattctgcgacacccatattcttttcatttgggcaatcacagatttctcgatgatccatttttcggtttcggcattcctcctgcagttcgtacacaatttctttcgtagaatctgtcgagccatcatcaataaccaacacttcgatatcggcatcggtggtctgctgtatcacggattccacagcctgccgaatatacttttgagcattataggcaggtattataactgatatcaatggcttcatcttacgctccttactttacgatcttcattttaccttccgagtcaatctgatacactttctttccaatcgttgttttcatgtctgtatacatctgtccgtccggtccaaagtagtaagcagctccctgtattcttaccttcttatttcttaccattgtagaatactttccgaaataataaatatgtcctctgtattttaccttcttttgtgtagccaatactccgtttgcatcgacataataggtactattccccacatcaaacattgtgttacgcatcaggacaccctgctcatccaaataatattctttaccggcaagcgtaataaactgatcggtaacttttgttccgtattttccgtaataataagttttaccggcgcgtcgaacaaatttcctgcatgccataacgccgtcatcatcaaaatggtattcctttccattcatttccaggaaacagtcctgcgccatataaccggattcatccagataataggttttacctcccctggtcaccattttgtcaaatacctgcgttccatagacgccaaaatacgcagttccttcatccaattcaacaaactgctgctgggccatccttccatttgactggaagtaataattttgattctcataattacgaagctcgtccgtcacgatctctccgtccggttctacaccataggtatatgctccaatgtctctcagcgaaaaatcttcgtccccttcgagtttgattccctcgctgttaaaataatacaatacacctctcacttttgaaaagccggttttcatgtaagccaaatttcctgtttcagaccacataaaataccgctttttcccatttttgtaaacaacccacggatcatagttaccaaacttatcataattaccgtatcccatacgacctccttcattaaagaagtacgtacgatttccgatttcctgaataccggttaatggcattccgtcttcgtcaatatagtaaaagtcctttgggcgattcgttccgtccgcaccgtatacgccaacccatccggtcagtttctttgcggtcggaatcgtattgcctttatacagctcaatagaaccatttttgacatggtaaatgattgttttcttttcagatgcaatataataaggcatactggttgcacgtgtaactttacacgaactctcaaaccgccactctccggtttgcgcgtcaatataagcatttcccgcattctgtgcaaaagaatatatcggatcgacataattcagcagcatcgacgtattacctgtcgcagtaccatgatgtgccatcttgtaaatatctgcatgcaattcatagcctaatgtctttaccagagaatccgcttcatctctaagcatatcccctgttgtaagatatgacacatctccacaggtaaattttgtgatcagagagcaattgttttcgtaatacgtattcgggacccgatcaccatattctgttccaatatcaccttccgaaactttaccattataagttgacggatgaatactgtttacgaaatcaagatcaggaccgattacatttgccataacatccccgattcgaaaacaagtccccttctgcagatataccatggagttccttccgcccatatactgatccataaaatgacacaaagcttcatacttctgtgcatagccggcggattccggtgcaacaaccgggtccgggagatacaaagtatcaatctgtattccgtaatcatacagatatttcaatccataaagccagtcctgacggcttcctcccacatgatctacatgcagatgacttagatacagatcaatattggtaacacccaatcgatcaagttcctgacagattgcaggcatgtgtgaagacatgcccaggtccataagtaaataatgcccttttgattccagtaaaacggaatcacctttttcattcgaattcacatatattccatataaattcatttcctgattttgtgccgcataagcttttgtatcagtaccgaacaaaagtactgtcacaacagctgacaaaatcagacatacatattttgtaattcgtttcatctctagctttctctttcttccattgtcagaaccgcacgtctgattccttctttgatgtcaattctgccgatccatcctaatgactgtaatcgtttacttgacaggatttccggtgttttttctgaataatccaataccggttccgcttcatcctccttatttgcaaatgacaatttcaactttctccccggaaatacctctgtggctgcctttgcgaaattacgaatggtaacatcggaattctttgaggaaatattgtaaggcacaccggattctccattaagtaaaattgtaagtaaagcacttgccgtgtccgtcacataacagaacgaacgatacgctccgccgttacttttcagcaaaatatcttcctttcggataacatttgctaaaaactgtgcccatacacgatcatcctgcaacgtgctggctccgtaaatatagctcggtcttgccagtttaaccggaagtccatactgctttacataacaattgcatacggtttccatggttctttttccggtcgcatagcagttataataatcatcaatattaatatacccaagatcctcttcttctatctcaggttttccgtttttcacttcaccatatacttttaaactcgaaatcatcagaaccccaagtgccttttccctgcaggcatattgtaaaatattggaagtgcccaatgtatttgcctcaattgttccaaccggatcattctcaaaataatacggtgttgcctgacttgctgcatgaatgatataatccgcatgctccagatccgataaatctccgcatacatctttcgataccagtttcaaatcagaccgttccagaatttttccgtattttgcttctgcttttgcctgattacgaaccaatcccattaccgtaattccgagatttttacggtcattttgaagcaacaaagcaagggtaagatagtatgcaataaaaccgtttgctccggtgatcaaaaccgtcttattcataaacttattccagtcgatcggtgtatctgcaatctcggtaacatctttgtataagttttttcctacataatcttttatgaaactcatctttttctcctttgacatattgcaagaataagacagcttttcagctgccttatctccactcttataatccgtatttcaatacttcttttgcaaactgcttataatgctcataatattgtattgcacgaagcgattcaagatcttccggtgttgtcactttaatattctctctgattccctggaaaatatgaatattttctcctaattcaattaacaattctcctgaagaaaccggatcaagatgcttttcttccgcttgttcatgagcccacatgatcttacgcatggtgtatccctgcggagcctgtgtaatgaacatttttcttcgttcataatttttattgcaattttctccatcctcactgtaaagaacagaatcaatacttggagttaccggtactgcagactcatactttttggcatcctcgatgcaggttgtgatcagatcttcactaagcatcggtctgacaccgtcacagataaggacaatatcatcatcactcgcaacctttgcaacctctaacagtccgttatgaatggaatgataaccggttgctcctcccggaactgttttaattactttctttattccgaatttctcaatatcctgatttaagacatccagccaattttcaacacaaaccacgacaatattgtcaaccatcggatggttggaaaaatgctccattgttcgtacgataatcggctttccttcaatttccaaaaactgtttcggaatatccaaagacttcattctctgtccaattccacctgcaaaaattaatgctgaaaccataatatttatcctccacttttatgataattgtaaataatcgactaacttttccaaagcatgaccatcacatgcattcatgtactttgctttaaatcgctgcattttatccctgtcaaagcgatcctcagcatgtacgattgcatcgcataacttactttcttcttttacaattatgcccggcatctcattataatcaatgtaaaactgatcattcttttcaaagtagtcaagatcaggtacatataacacaattggtctcatcagtagtaaataatcatatattaccgatgaataatccgatataagaacatccgtaaccggcagaattcgctccgttggaatcggacaatgttctccttttaggtgcttctgcatatgcggatgcagattcacaaccaaaaaccattcatttccaagctgtttgcgcaaatgtccgataaaggaacaatcgataatttcaggttgcgaagcatttccccgaaaggtcggagcccacaatgcgatcttcttccctctcgcctcaggatacatcgcataaaattcatcctcacacaactgcttgtatcgctgctgataaaagcggtccgtacgactcagtcctaacgccttaacaatatccggtgaagcacgcatcccactcacataggctctgttacatgcttcggcacttgtaaggatcaaagagtaattcttaaaaacattcccattatagtacgcaggaatatcccgcggcgtatcatatgcatacttttttagcatgccgccggcatgccacatttgtacgaccgttgtttcctctctcttattacacgatgctgccggaagaaaattatcacacaaaaacacataccgtgcctttgcataacacaacataaaccgcagcataaactttagcccgcctgcataattaccgccatcacagtctttcgtcagcttaagtaccttgtaatcggttgtttcgaaccactgatacagatcttccatgctatatggaatatcatcatgatgagagtccgcaaatattaccagacgatcatcaaccggcgctatctttccaatccgataaaagaatggaaaaacaatattttgcattataattttaacaaattgtttcaccttaaaatttagcatattatttggccattaattcattgatcttctcgacaatacgttcactcgcatgaccatcttccatgcagcctctcgcagccagaaatacatccttgtcttttgcatacttttcagcatcaaatttacggatattatccgcaagctcttcactgctcgttgcaattgggaatggagttgtatcgatcggataataaaatcctctcgcattctcataatcttcaagattcaattcaatgataaagcccggtttgccggacaatacaaagtcaaagatccagctggaataatccgtcagaccaacatccgtgcacagcaggagttcctgcatatcctcataaaaagtagcatctgagacatatgacggaagaaggttcaaccaggaacggctttctttctttaaacggttgtgcaaccgaatcacaatctgccacttgccaccaaatcgttcttccagtgcttccttaatcatctcataattaagtggctgataggactcatccacatcatcacgatgtgtcggtgcaaataaaaagatatgcgtatcttcatcaatgtttaagaaacggtgcactttcttattaatccgggcaaccttctcttgatcctttataaaaaagatatcatttcttgcatgtccgacaagaatggaaggtacatccttccaatatgccgtacgaaatacttctgtttcaaaattactgttcgacaataagtaatcgaccgtcttctgacaacgctttgcaagctgtttccaacggaatcccataacaacatccccatcaagacgcttgatacccaacgatccatgccaggtctgaagtaaaaactgctccttctttttatatgcatataaacgctctacaatatttgtattctcgataataacctttgccgatgccagttccttataaaattcgtacgtattatgtctgacgaatttcagacccataggataatcacttgtcggatatgctgttttcacatcccacacgagctgataatccgagttctgcctcagtaactcttctgcaatatatttagggttacaggtataatccccctgaaaagttaagaacattaccttattttccactggtgttttctttgcaagatgatgtctcgctaaaacagccaatgccttatccggataagacaaaatctttatgataaccttaaaaacaatgttgattacactagaaataagccgaaacaccaatgttaaaatagaaataatcaaattgttaattgttcgaaatatccattgaagaaacttttcttcaaccatctgtttctcaaatatgccaaataatttctttatcatcacacaatattctcctattttagttgtccagcatgtccataaacatttcgagataattcttggttcgagctctcaaatcatcacgaattgatttatcatagttagagttcatttctctttccattgcatccagaatattgtcgatattcaattcactctcttcaaaataagaatttttctttccaatcacgtctgcaaaaatacgcaatttttcactccagatcaatccgacaacgggtacatccaatgcataggatgtgatacatgcatgtaatcttgcaccaaagactaatttaaatgaacggatctgttctaaaaaatccacagaattgtttgctgtcggaagaatctttgttctatcgctgcatcctaatgctcgcaacagcattgtgccaaatttctgatctgcagccataccattcgaaaacagaacccaatcccaaccgcgttcctctactccctgcactaactttttatagaaattaagaagttcaaactcagatagtgtatttccatacgcctgataaactcttcctcggataacgttaattccgacaacattggatgggttctcatttcgtttcatattgtaacactccggaacccataatgctggatcaccaacatgtgcaatctttgtgttcggattgacaatatagttatttttcagagtgtcaatatcatcacgtgttgtaatcactttaaaacaatcctgattaattgctttctttaatctctggcaacggatatctgtttcactgtacccctcaattccgactccgttcatcataacaggaatattattttttttggcgatcttcataatttgctctacataataatttaatccctgcgtacgaaatttgaggaatccaccacctgcaaaaacaattgcatcaacgtcttttaactgtgtcttaaatttgcggttgatttttaaccaccacataaaatattcatagtaatagcgaaatttgcttgaattttcatatttaaatatagatccggaaattcgaatcaatacttttgaaatccaaaatggtatcagttctaaccctttgtatgattttatacgtggattgacatcaacttccacaatctgaacttctggattcttttgtttaatcaaatactgcgttgcctcacacagaatattgtccccggcatttttgatagcatagagtccaattacagctactttcttcatatctttgttccttccgttttaatcttcagcatccataaacgcttcgtatttgtctaacacttcgttggcttcgccgatcataatcatttctccatcattaatccacaaaaccttttgacacaattctcgtaatgatgggatactgtgagaaacgataactactgttctcttatcatccgaaatcagatctttcatttttttatagcttttcttcttaaatcttcgatctccaacgctcaaaacttcatcaattaacataatgtccgtttctaatatcgcggtaatggaaaaagccagtttagaatacattccgcttgaataggtggaaaccggcatatcaataaatttacctaaatccgcgaacttaataatacggttcatttttgcccgaatttcttcttccgaaaatcccaaaagcattcccgataatataatattctctcttcctgataattgtttctgaaatccaacaccaatcgacaaaagtgaaaccgaatgtccatacgtatcaattgttccttcgtctggagaaaagatattggcaagtgatctcaaaagggtggacttaccacttccgttctttccgatgattccaaggatttctccctcttccacttcaaacgaaatattttttaacgcttcaaaagtttctcgtttattcttatggaagcgaagaaaattctgtttaatggaaaaggatttcaaactcttgtatcgaattgataaattatcaacttttatagcgatctcttttttccccatgctcagctcaccttcacataactgttttcatttttgtaaatcaaacaaataccgatccaacttaaaccaacaccaattacaatccagataagaaggacattcaattccggtgtttctccatagatcagacacttacgactgctttcaataacaaatgccatcggattaaattttcccaaaaccgtagccaattctggatgatccttacctattcggtggctaatggaaaacatgatacctgtcatataaaatatcaatttcaatacaatggataccacatttgacagatcctgtacatacactccgtaatgacaaagtatacacataagaccaaaagtaaccaaccaaaggcaaaccataagcggaatgataaaaataatattccaggtcagatggacatgataatacaccattaaaactacaacaattgcaaaagataccaacatcttaaaaccattaacaaacatttttgattcaagcaaaataaattttggcagatacacctttgatacaagtcccttgttcttctttatgatggtaacactattttttagattttgattaaaaaatgtccatattgccaatccaatataaataaaagcagtaaaatacttttctcttgcactaaagataaagccaaaaataaacgcataaataaacattaagcataccggttccaatatccaccagacccaattcaaatatgatccagcaacttcagccttcagttctgcttttgctgaatatttcgcataactataatattttttcatatcatctataaaatgattcataattaaaatttcctttatctatccaactgcaatagttttgattatagcataggaccctgtatatttcaattcaaaagtccaattatcgcttaattgccgtagtctgtttttcatcaattccctctgtattatctcttacaaaaagaatcttaaatgtcaggaataagatttttatatccatccagaccgaataattttcaatatacgtcagatccagcttcaacttgtcatatggtgtcgtattatactttccatatacctgtgcatacccggtcagtcccgcttttactttcagccggagtacgaattccggaatttcttccgtatactgatccgcaataatctgacgctccgggcggggtcccacaacagacatctcaccctttaaaatattaaacagctgtggcagctcgtcaaaatgaatggcccggatcacacgaccgaccggcgtaattcgtgcatcttcttttgcggcaagacgtgctcccgcatcctcggaatgtgtggtcatgctgcggaacttgtagatcataaacggctctccgtcttttgtcagccgctcctgcttgtacaataccggaccgtgatcatataatttaatgcaaagtgcaatcacaatcataaatggagaagcaattacaataccgatcagggaaatcacaatatccatcagtcgttttacaaacagatctacaatgccaagcccctgattccgggacagatacagcggtgtatcaaacagatgaatatcatccgctccacgaaacagaatatctgaaatctttggtgtaacatatgtgcggatagattcctgataacagtatttcataatctggttgcgtacttccgatggcaggtcacacagaaccaccgcattgtatttctgaatcatcggatacagcttttcataacctatccggtaactttccgctgcacagatattatacttgtcctttctggtattgatctttgcaatcaaatcatccggcgaataatttccatatatcacgagcatctggcgcggcggatacagacgcgtatatgcctttcgcaccagtacgacccacggaacgataaatataatctctgttaccgtcatcagaagcaatggctgtggtggcagataatcgttggctaccagacagatctcaaaatatgcaacaatcatcgcaagaatcactgccaatatctgggataatataatatccgaaatccgcatatatccgatccggtatcctccaaatatcttcgtgaaaaagaacacaaagagtacatacataccaatcactgcccagttacctctgttgaaaaaagtattcgctttatccagcatcggaatatagagcatataccatacccatccgaacatagccgcttccaccgcaagcgatatgatattcgccgtaaaattcaataaatgcttgtatttatctttcatcaaaactttcctctaacatgtagttttccggttgtaccccgcaaaaattttattctcccagtccgctttccacataagcgaccagttcccgaagtgctccctgttcatcttctccgtcacagataagtgtaatctcatctccggatttgatacatgcacccaggacgctgagcacacttttggcatttgctgtatttccgctgtactcgaatgtaatcttgctattatatttcattgcctctttgcataaatttcctgccggacgtaagtgcagtcctgtaggattaataatttttactttttgggataccataagaacgcctccttataacataactttggtaatcagatcagctaactgctttgcttcctgctgaatcacttcctgatttttgccttcgatcatgacacgaaccaatggttctgtaccagatggacggattagaacccttccttctccggcaaattttttctccagttcaccgattgcctctgcaatttctgaatattccatgtaactttcttttttatggttcggcacttttgcattgaccaatgcctgtggcagcacctccatgatctgtgcaagttctgataatttctttttggtttccaccatcacctgcaataagtgtaatgcggaaagaagtccgtctccggttgtgttgtcatccagaaaaatcacatgaccggactgctctcctccgagattatatccgttttccaacatattttcaagaacataacggtctccgacttttgttttctccacatgaattccctgtttttctcccatcagactgaatcccagattcgtcatcacggtgacaacaatggtgtcctttgcaagttttccgttttctttcaggaaatttccgcaaatcgccatgatctgatctccatctaccagctttccgttttcatctacagcaagcatacgatccgcatctccgtcaaatgcaataccgatatctgccttttcggaaacaactcttgcacacagttcgtccatatgggtagaaccgcaattggaattaatgttcgttccatccggattggtatgaatagcgatcagatttgcccccagatctttcagcgtcttaaccgaagtataggaacttgcgccttctgcacagtccacaacgatcttcaacgcagacagatctaccggaaccgtctttttctcaaacgcaatatactcatccacaatatcaaaccgatactcaaccctgccgattcccggtccgatcggaaaaacaacgtcttccatatcattccggatcaatgcctcgatttcgtcctccagctgatcggataatttatatccatctccattaaaaaatttgattccgttaaattccatcggattatgggaagcagaaatcacaacccctgcatctactttatgtttccttgtaagatatgcaattgcaggtgtcggggcaactcccacaaaaatagcatttgctccgactgaacaaattcctgccatcaatgcatttgcaagcattcctccggaaattcttgtatcacatccaatgatgattgtcggctggtgggactgttcctttgttaaaacataagcgcccgcctgaccgagcttcattgcaagttcaattgtaagctctgtccccgcaactcctctgactccatcggttccaaacattcttgccataataattataactcctttatatactttactattcgccggtatcctcaccgctgtctgtcgaagtatctccgtcctgtgtattcttcgctttcacggtaacgctgacagtaatcggctgatatgcataatgatcttcatccagtttcagtgaaagttccacctgatgcgttccctcgctcagctgggaggcatcaatggatgctgccagctccgatgcattcagcttattcagatcatcctgcagcccactgatcgtcacagaaacctgtgccttatcaaaagataagttcaggccgtccggcagactgttaaccttgatatcagatgtcggcagatgataggttctggacgcatacgcttcaattctgacggttaccgtaacggatgccgcagaagaatctaccagttccacgccgtccggcagatattcggaaatatcaatcgttgtctttacatcattttttgctccgctcacattgattacatttgccggaatttcaagtgaaacaaacggattgagtacattggatgcccctttcagtttcacagtatccggtgtgctgctgatctccactacccggtattccccgtatggggttcctgttgtcgaaaatacaagcggtacttcctttacactcaggatttttgccgaaatcgtcactgtcgtattgctcagcttcagctgggtggtatccacttcatttccatccgaatcatagagaaccggaatcacattatccgtcagattcgatgacattccatccacatcaatcgtagccacaaccttatctacttttttcacaatagatgccggtcccgacacgttcaaaacattcgggtttgtcacggaaacttctccgagggcatatcccgatgccacttttccgctggtgtccgcggaaatcataaatcttctgctcatcagatcttccagggaaagttccatatatttgtttttattgttaatgctcacggatgtatacgtccgcttggcactgatctcgatcggaacactcgccttattccccttgtcatttatgatcaggcggttcatatctgccaccgcagagaaatcggtgtcatcaagtttttcaagttcactgcgttttccggtcacagtaaaggtaaccgtgttggttccgtccagcacttcatagcacttgttcatatctgtaactgcggacgcattttctaccgttacatttgttgtaaatgtttttgattttttcggatcatcaatattatatacaaccagccataagataaatgcaagaactacagccagaattttaaagcccagattattcaccaaggtttttagaatcttttttgccattcataaacctccttttcagcagtcccagtttggtcatctgttgatttctgttctgcagatactttaatttgcctctcagaaaatccgcattgacattccggtaaatctgtccccgcatagcgattgataccttaccggtttcctccgaaactacgatcgtcagcgaatcgctcacttcactgattcctacagctgcacggtgtctggttcccagatctttgctcagtgtcatactgtccgacaacggcagataacaggtcgcggaaaccacacggtctccacgtacaataaccgctccgtcatgaagcggagtatttttttcaaatatattaattaacagctggctgctgataattgcatcaatatcaattcctgttctcacatattcatttaacaggatttcatcttctattacgatcagggcaccggtttttactttccccatggcataacaagccttgatcagttcgtcaattgtgtggtcggaaaatttattttcctctacttttccaaagtcaaataactttcccaaaacattttttccgccaagattctcaagtgccttccgaagttccggctggaaaataatcaccagggccgtcagtccgacactcaacgtattttctgccagccagaggatggtattcatctgaaagattgctgcaacgagtacaaacagcagaatcacgatgattcctttgaacagattccacgcacgcgtatttttaatccaaagcagaatatgataaaacaggaaggaaatgatcagtatttccacgatatccacaaaggaaaaagagatatccggcataccgaacaatcctgttgcattgtcataaaattggcttaatgttcccagaaaattttgcatctggctcctcttttcttcatttcattattttgatgcttcgttccccttatttgagtaaatcctcatcaatgtccagttctttcgcaataaccttccggctgttctcttcctcttccggagacagcacggatctgctatggtcaatccgctttcccatgcttgcggtatttccgaaatgttttaccgtaacctcacggacagcgaccattttcttcggcacagccttgacataataatagtaatcatcatcctcaaactgcacccgttcggtccgcgcataatccagattcataaacagaaactgaaggataaatgcaataagcagggaaataatattgccgactatcagccataatgtctttcctgtaactccaagaacaatataacctacaaataatccggcaatctgaataagcgcaccggaaataattgccagtgtccaggcattatccacttccatccggcgtaccagataaactacaatggcagtaatcacaaagataacgattaccagatacatttctttatttcccagaaactgccccaccgaaatatcaaatttggaagaggactgttcctcatctgcatttgccgcactcatcagtgctcctgcattccggtgaattccgtctaggaaataatagacaaccgtaccgcataccactccgatcacggaatatgcactgcgcagcaggctgctgccaaccggcatcacatacggaatatgcagtttaaaacacagcggtgtaagcacaaccgccagtccgtctttcggtgcgaaacgaaaatatacaaagaacagaatcgcaaacaaaatcagtgcggtaagtgctacttccatggaaagcgcatacatatctgcaagcaccacaattgcgccaatccataatatggcaccagtcggcagaatggcacagacaagcgccagcagtaacgccaccggaaaccggctgattttctccatgaatccgatattggtattgatcacggtaaaaagagccagtgcaacggcaaattttacgatcggatacagatatgtttcatatttactgtaaaaccggatcagctgatcctttatttccaacaacttcgtcataaatcctccctgttatgccccatcctttatttttcttcccgcagtaatctgcgcgctctcttcagatgatttccatatgctttcatcttgcgatagccttttgcataccgggcacaatagatcagtgcggtaatcagaagatacacgatcataaatccggcatatgcaacaataagtttcgggacgaacgtcgtaagatccacgcgattgatccatttcgtaattgtatcaatatccccgagtccccagaacacgatcagaagaataaatgcgatggttcccgaaaagaaactttttacaatttcttttcctacatagtcccacatcgtatattctcccgcctgatgatattttttattttcatattcatcaaatgctgcaagatgatataattcttttacccgttcttcactgatcatagataactcctgtctcgaacgcatcccggaatttggacacaatgatgcattatttgctattataccatagatagttcttttttcaaagtctgttttccaatcgcccgtttccatgaaaaaagccccggaaatatccggggtctggttatttgtccactattcattttttaaatatctcatacggtccctgtctctggtagagcgtaagtcttccatcttaggttccggtttctgataggcattctgaaattcgtttgccattctttccttgcatctttcgcaaaaacgtcccgtgcggatcggtttcccgcatttttcacatacaatccctgcttccgttgctgtggaaagaatcagtctttcttcccttacccactgccggatctgcttggttgaaatatcattgtccgttgccgtctgctctacagaagcgcccggatgctcttcgagatactcttttacttcatgaaatttatcttccagttttttctggcatgccggacagatacgctcattgttgagaacattaaacaatctgccacacattttacaatttcttacatccatagtatccctcctaaaagcctctgccaatgcaggcagtcagcacataaacctgttccgcacccgcttcttttaatctctccgctacagcttctactgtagatccggttgtataaatatcatccacaatcagaattctcttatattttactacattatccggactctgaaaagcatttttgacattattttctctttctctgccattcagttctttctgtggtcgtgtatctttcacccggatcatcagacgcggaatacacggaatatccattttttctgacagtgccctgccaaaaagcgcagcctgattatatccgcgataccgttcttttttcgaatacatcggtaccggaacgatggcttcgatccttttttcccgcatccagttttcccagcgctgcatggcttcctccgccagaaaacgggcatatctcctccggtttgcatacttaaaccggtacatggatttctgcacagccccacgatatacaaaaagcgatcgtccttctgcaacaaaagaacgatgctttctgcaattctgacaatattctgtttcggtatccgcaagcgggcttccgcaatgataacagtacggctgcacaacgggatacaattttttccggcacgctgcgtgaacatttcgctgtctgcggatatctgccgtttccagcagacggtcgcatacaaaacagcgtggcggaaatatacattccagaaaattatccaagacggatacggtttcgaacttcaatctgtgctgccgctttttcaaattcagcctctgtcatatcttttgtagtaaatccaatctctcctgcaattccggcatctgcatattctacactgccaaatgcattttcgattgtttccttaccggaagaagtgcgtacaaagaaactgtttacactgtctttgtaatctaccagtgtcagtttttccggtgaccagtcaatgtaaatattggtatttttgtgctttgtcatatccacgatatctgctactactgcacttgctgtcggaagcttacctgctccgctgccgtagaacattgcatcgcccagtacatttccatgtacgaagattccattgaacacaccgtttactccgcaaagaggatgctctgcgctgagcatgaaaggagcaaccatacaactgtaactgtttccgactttacggctggatgcaagaagcttaatggaacggttcaaaacctttgcatacttaaaatcatctgctgtgatctttgtgattccttcgcagtgaatatcctcaaaatctacctgccggccacacaccagagaggttaaaatggcaatcttgcggcacggatcatgtccttcgatatccgcagtaggatctttctctgcatatcccttttcctgtgcgtctttcagtacctcatcgaaatctgcaccttcctccgccatttttgtcagcatgtagtttgtggttccgtttaagatacctgtaatctcttcgatctcatcggcagtcagacatttattcaatggacggataatcggaattccgccgcctacacttgcctcaaactgaaagtttacgttgtgatcccgtgcgattttaatcagttccgctcccttggctgcaaccaggtttttattggaagtggcaacctgttttccagcctcaagcattgcttttacaaacgtatatgccggctccacgcctcccatggtctctactacgatgccgatctccggatcgtttacgatcgtctgataatcatgtacaatggcatcttccatagggtctcccgggaattcccgcagatcaagaatatatttgacatcaaccggttctcccgcgcgctttgtgatcttttccttgttaattcttaatacatctacgacaccggaaccaatggtgccatagcccataactgcaatcttcatttttcttactccctggctaatatttttgcataatgaatcccctgcacagattcaatactgtttctcatatcctccacattgcccgtcgcagggaacacatcaatactgagcgacaatgaagcaattccattaaccggaacgctttgatgaatcgtcagaatgtttgcatgaaattccgcaattgtttttaataccatggataacagccccggttcatcatccagctggatcaccatattgaccgtttttccttttgcattttcatgatatggaaatatatcgtccttatatttgtagaaagagcttctgctgatctgtaccatctctgtggcttcctgcacagactccactttaccggaatccagcagccgcttcgcttccacgactctgagcaatacctcaggcacggcttttgcccgcaatacgaagaaagatgccttctcgcccatcctaatttcctcccttatgtattgtctgtctacgaccgacacttgtgctcacttgaaagattctaccataagaacatcaatcttgcaagaggtatcggggatctgtccccgatttttacgctctcggctttccgcagttggagcagaaatttccgctgttaacctgtccacagctacaggtccactcggttttcggtgccggttttccacagttggaacagaattttccctgattctgctgtccacatgcacaggtccagcctgccggtgcctgcggtgcttgcggtgcctcctgcccagcaggaggtattgcaggcaccgccccctgcgtcattccagctggtgcacctccattcatcatctgcatctgctgcagattcacatttgatgccgctcccatcataccaccggatatattggaagccattcccattcccataaaaccggccattgaaccattggaattacttcccgctgcctcaagccctctggctaccgctccctgcacgtatccttcccggaccgtcggatcggaaagcatggctccttcatttctcatattcagcagtttctgcgattcctcgctgtaagaaaccgtcatacctaccgcctggatttccataccacgggtctgattccattcctcatccagaaccgatgacatatactttccaagttctcttgccttgctcgaaacaaaagaaatacggaaaccatctgccgacatctgatttacggatgactgcaaagcctctaaaaactcagacagatactgctcattgatttcgtcaatctctacatgatccttatttttgggaaccgcttccgcataaaatttgagcggatctacaattttaatcgaatatgtgccatgtgcacgcaaaaacagttcggcattatagaacgaatcaaaataattgattggctgtcttgttccgaacttaatgcctttgatttcctgcagattgacaaaaaatacccgctgtttctgcggcgtctgtccgccgaaacggaaacgatcaaacgattccttgatggaatctcccagttgtccgttgagcagtgacggcatggaagaatgatccactttgtaatatcccggctctgctgtgtaatctacaatcttgcctccgtccaccagcatcataaactgattgtcatatacatgaatcatggaaccattcgacacgacattgtccgttccctttttattttccccacggcggatcagtgttcctttggtaaaaacggtctgatcccccatattatctgcttcaatgacttccagccactgatctgcaaatgcacctccaactgcctgcgttactgccttaataattcccattacgctcctccttattcctgtttttatttacacatcatcactgtccatatttttcggacatcccaggctctgccatttcagatatccattgataaacggatcaatgtttccgtccatcactgcgtccacatttccgctttccacaccggttctgtgatctttaaccatggtatacggctgcataacataagaacggatctggtttccccagccgatatctgtcacttcgccccggattccagctgctttggctgcattttcttcctgtttgagaagatacagtttcgctttgagcatctgcatcgctttatccttgttcatatgctgcgaacgctcattctggcactgcaccacaattccggtcggaaaatgcgtgatacggatagcagaagacgtcttgttgatatgctgtcctccggcaccactggagcggaacgtatcaatacggatatcttcctcccggatctccacatcgacatcttcttctatatccggcatcacatcgcaggatacaaaagaagtctgtctttttcctgccgcgttaaacggagaaatacgaaccagccggtgcacacctttttccgatttcagatatccatacgcattctccccatttacctgaaatgtaatggatttgattccggcctcttctccatccagagaatccagcacttccacggaaaatccctttttatctgcccatcggatatacatacgatagagcatggctgcccagtcacaggattccgtgccacccgctcccgcatgcagggaaacaatggcgttgttcctgtcatattctcccgacaaaagcgttttcatacggatatcctcataggtctgaacaaattctttcatcatctgatcgatctccgggatcagttccggatcattttcctcatatcccatctcgatcatggtttcaatatcatcatattgcgccgacaatgccgcataagttgccacatcgtcctttaaacttttgacttccttcatcttgttctgggaaacttccggatcgttccagaaatccggtgcctccatctcccgttccaattcctgaatccgctgttctttgccagctaagtcaaagtgaatccctcacttcctgcagtggagccttgtagctttgcagctggctcttaaaattatccaattctaccacagaatcacctctttctatttcttatttcagacttatgataatataaaataatatgaatagcaagcaatgcaagaaatgctcctgccgaatcaatcagcacatccgtcactcttccggctcttcccggcacaaacagctgatgaaattcatcggttgctgcataggctgccgttatgccaagtgccatacatccacggttctttttccggtcaaatgccgtcaatgcctgaaatatcagaagtgcaagaactgcatattcgctcatatgtgcagctttgcgcacaggatattcaattttctgtgccatctgttccagttccggcccggaatgtttccatccaaacacctgattccacatcttaacaatccggtaactcacatgcccgctgatttccgaagactccgtatccggctgtgcggaaaacgaaaaaataaccacagcccatacaacaatcaacgcaacactgacaattctccatacacgttttcttttcattgttaccctttaatttattttttctttcacaacagaaattgctttctgtaactgattatcgtacttcatgtcataactttcatcttccggaccgctgtatttgtattccagtttgatatccggctgaatgcctttcccgtgaatgtaatgtccctttggcgtataatatttcgcggttgtaattttaatggcatccccgttttccagaggaaataccgtctggacaattcccttgccaaacgtttttgttccaatcaatgttccataatcataatccttgattgctccggcaaagatttctgatgcactggcactgtctccattaactaaaactgccatcggataatgaatgcaggacgcatcggatgtatatgtctcttttttcccatatttatcctccgtgtaaacaaccgttccctccggaagaatctgatccagaatatccacgacagaagtcaccagtccgcccggattgctccgcacatcgacaatcagccctttcatatcttccttttcaagtgctacaagtgcctttttaaactgttttgcggtattactctggaattcgctgatctgtatgtagccgatcccatcggaaagcattttggaatccacactcggaatatccacgtttttacgttccacatcaaattcaagattttccccggtctgcgaacgataaactttcaaatggacttttgtcccctcttttccccgtatcttttttacaaggttggaaagttccatactggtcgcttcatacttatccacggatagaatttcatctccgtttttcagccccgcttcctctgccggtgttccctcgtacactttaaccactgtcacttccatggtctttgcattctgtgaaagcgccgcaccgattccataataatttccattggttgatgtctgcagatctttatattcatctaccgtgtagtatacggaataaggatctccaagcccgctcagcgttcctttataaatggcattgcggatatctttttctttgtaagaatcgttgtaatacaaatcgatatatgacaacagctcatccactttctttattgctgcctggtcgagaacattgtctttggctgtctgttttactccctgtggtccaaatataacataattgtttgtaagattcgcatacgcacgaattccgactccggcaccgattcccgtaatcagcagtcctagcaccagcccgataatcactccgtttttaaagcccgatggtcttcttttttccggtttcccggttttgatcatttcttcctgttcttcctgcattcctgcctccataattttccctataaatcaagaagccacaccttgcagcatggcttcttgtcattttatgacaacaataacaatattatactttcaaatgtttgcggatcgtcatctgactgccgataaatccgataccggctccaaggataactcccaccggaatcagtgtccggaaaacaaccttcaccggttcaaacacgatcatcgaaccgataaaattgaatttcgctgcaatatagacaatgatcttctgatacataaaatacagcacaccaagcggaatcgctgctccgatcagtccgatcacaattccttccacaataaacggcgcacgcacaagaaaatccgttgctccgatcagcttcataatggcaatttcttccttacggaccgagataccgaccattacggtattgctgatcaaaaagacagccacacacagcagaatcagaataattcctccggaaacatatcccagcagtttattaaaatccgtcagtgtatttgccacctgggcagactcttttacctcacgcaccccggtaagtcccttgatataggttacaagggaatcctgcatcgaaacatcgttcagatacacctgataatgtgcagaattcgcaagcggattatctgtaaatccatccgcaagttcttcttttccctgaaaatatacttttttatattctttccacgcctcgtcggcagacacatactcgtttttactgacctcggcacgcttattaatcttttctccgatgtcacggatctgtgcatctgtcgcatcattttcaaaaaatacggtaactgacacaccctcttcaatagaatgtaccgtcgcactgaaattcgttacaataatataaaacagaccgaacataaaaatgcaggccgccatggttgccacggaagcaagcgaaaacattttatttcgaaatatattttttaagccctgtctgatcgaataaaaaaaggtattaattctcatcgtcgtagccaccttccttactgtcactgacaatcgtaccctttttcactgtgatcacacgttttttcataactttcacaatttccagattatgggttacaacaatcactgtagttcctttgctgttgatttcctccagcagtttcataatctcccacgcattattgttatccagatttccggtcggctcatctgcaagcaaaatgctcggctcattgatcagagcacgggcaattgccactctctgctgctcacctccggatagctgtttcggaaaagaacggtattttgcggcaagtcccaccatagaaagcataagcggtacttttttcttaatatggctgttcggctcaccaaccaccttctgtgcaaacgctacattgtcatagacattgcggtctttcaacagacggaaatcctgaaataccactccgatgtttctccggaatttcggaatctgctttctgcggatcttcccaagctttttccctgcaatggtaatgcttccttccgttggttcgagttcttttaacaacagtttaatcagggttgactttcccgaaccgctgtctcctacaacaaatacaaattcaccatcttctatttccagactcacgtcatttaaggcaggaactcctgccgcatatgtcttgctgacatgttccagtgtaatcataatctctccttcaatctctaatagtccagtgtttccatatacttcatatacttgactaccatgagtgcgatcttaaacgtgattgcatcttcaaaaacccgcagatccagacctgtgcttttttgcagcttgtccagacgatataccagcgtatttcgatgaatgtacagttgtcttgacgtctctgacacattcagactgttttcaaagaatttgttgatcgtcgtcagaatttcctcatcaaaatcatctggtgattttccaccaaagatttctttgataaacattttgcacaatggaattggaagctgataaatcagtcggccaattcccagctgggaatacgcaatcacatcctgtccctcaaagaagatctttccgacatccagtgccatgcgcgcctctttataagatctcgaaacctctttcaattcgttcacaatggtaccatatgcgatatgaatattgcaattggtatcagatttaaacagcctgatgattacatctgctgtcttattcaaatcctcataggtttcattttctgcaagttctttgactacaataatgtttttttcatctaccgctgtgacgaaatcctttgattttccaccaaaaagtccccggatcttctccagctcatttccatctttctcacggtttgtctccaccaagaataccacacggcgtacttctgtttcaatatgaagtttcttggcacgattgtatatatctaccaaaagcagattgtccaaaatcaggttcttgataaaattatctttatcaaaacgttccttataggcaaccaaaagattctgaatctggaaagcagcaatctttccaatcatatacacatcctcgctgtctccatatgccagcagaatatactccagttgatgatcatcgaacactttaaagaactggcagccatttaccacctgactgtccgccggcgattccacgaaggtctgtgccggagctacaaactgttctgcatccggaaatgtcgcgaccagaatttttccctctacatcaatcacacataaatctgtacgtgtaattgctttcagtccgtcaattgtattttgaagtatttgattggatatcatagtcagctctccttatccccatatttcatccagaaatctatcgttcccccacctgttttctgaacaattacttttattttaatacattcttccaaaaaaagaaagaggaaatgtatattttttatgcatttcctctcttaccactttttccggttagtaatatttcactataaaattttaacaatatcgttctaaaaatcatccgaatattccagaaatccctcgcccaaaacctcccggacatccgatacgattacaaacgcagaggaatccacatcatttacaatctctttcacacgcacgatctctttccttgataccacgcaatacagaacgcactttttctcctctgtgtacatcccctgtgcgtgcagtcccgtaaccccgcggtcaagctcatccatcagccgttctgccacttcctcataccggtttgtgataataaaagctgctttggaagtcttaaagccctccagaaaggcatcggatatttttgtcgacacaaaaatagaaacaactgcataaagtgtaggtcttaaaccaaatacatataagccgagaatcacaatggctgcatccagtacctgcatcacctgaaccaccgtatagtgccgcatgtgtgactggatgatcgccgcaaccatatcggttccgccggtcgttgctcccgccttaagaaccagtgccatgccaatgccggtaaatgccccgccaaacagggctgcaagcatataatcatcccctgacatatctatcaccggtatcagataaagccacaccgaaagcaaaatggttgcaaagcccgttttcccgatatatttttttccaaaccggatataggaatacagaaatatcggaatattcagcacaatattcgtcagccacagaggaattcctcccggcagaagcgcttccgtaagatttcgtatgataatggtaagaccagtaaaccctccggtgatcagccccaccctgtcaaaaatccactgaatggcaatggccataagtgcagtgcccagcaaaatcaggaaataattttccagttctttccagacatttgccctcatgatatgctttcctgctttccatgataatgaatcagctgccgctccagtttatgcgtgcggatcagattccgtatatttccgagcagtccctgcctgcgctttgtaaaatcccaggaaccgattccataccacagtccggcagacagtttctcacaattctccatcaggaaatgttcctgatccggacttggcagaacacttaagatcatatcaggagtcagtgcattgatctcattgaccatggcatccgtccccccctgacagttttcaaacgcttctgctcccaggatctcgcattttccaaaatgctctgacaaaaaagcacaggtcttttccacatgttccgcagtatctccgatcacaaacaccgtctgatgattgcgttccacccgcttcatcagttcaaaaaagaaatcatgatgttcgatctcatgacggtgctggtaagatcctgcaccaacagcttctaaaattccgttttccgcaatcacggtatgttccgcaaaccctatggctttgcggacaagttcatccgtttctgccagcataagcgtatccatgtttacttcttctattgtatggaatccatgatcagacatatccttttctacattcatgatcatttcccgaacggtataattgtccaattcaattccagcaaaatcaatcgttttaatcataacttccctagtatatcaaaaatacctcccgtttgcaatcattcaaatacatactttttatgcgttgttaacaaaacaatcgtttgtttttatccctgtcatccacaaacaacttatcccaaattatgtggataatgttcataacttcgtgtataactcgatttttcggcattttttgattccggatagtggataattttttcattttatccacatctgtggtttccatcccccatcttagttttgatttttttgtgcactttgtatattcgcgttttcccctgtaacggttatctgcattgcctgcgcaatttttgtgtaggaatctttctgataccccacatggcatccgcataccgtatactcataagaatttcccggcattcccccggtatccgtatatccggtttcctctgtttcttcgagacagacatatgttttcgtccccacgattctgcggtaaatacgataataatcagccccctgcaccgtattccatgccagtgtcaccgactcatccgcatttacaaccggtgtctgcagaaccggtgcctgatctaaaatcaggtcaaaatattctgcaatgcccgtggcatccgccacgccaagacgtttcagccggtcgttaccattcaaaaatgttgtactgtcatcgtggttgctgacataagcatgctccacaatcagtcccggaaagccggcatacttgctccgcttgatcacggcgtagtaatctgcctttgatttatccggatagcgggaccccacagccgaattccggtaaagaattccattatttttcagtccaagtgccaccagctgtttctgaatacttgctgccgccatttttccttcacttcccacctcttctttatacccgctgttcggataataaacacaggctccatggtcggtttttttcagggaagcattgttgtgtatcgcaacaaacagatctgctttcctgctttttgcaaaattcacacggtttccaagtgtcacaaaacggtcggaagaacgcgtcatatataccttcactcctgcatacttttccagttcggttttacaggcctttgcaatggcaagatttaactgtttctccttgtatgtttttccgccccacttatatctggcaccctgatcatgccctccatgtcccggatcaagaactacaaccaccggatctgcgtccggcgcctgatttgcagccgcatacacgtttcccggcgggaaaagaccaattcccagtattgccaatgccaaaaacacgcctgccatttttttcatttgtactttctttttcatttgtttcctactttactttaattgctgtggtgtttgaaaatgctccgtaatagttctttttgtttaccgttttgtatgcgcggaccttatagcgataggttgccccttttttcagttttgtattccgatacgaagttcctttgaccgctgcaatctttgtatattttccggtctttgtgttcagccggtatacctgatagccggttgccccggaaaccttactccactgcacggtaactgctgcatcttttgtactgagttttatcgtttttacctttgctggatttgcaggtttttccgcttttttggtcgttacctgcttttctgcggaatacgcgcccctataatttttatttctgtaagttttgtatgcactgactttatatgtataagtctttcccgcagcaagtttctgatcgctgtagaaaagcgtccgggcactttttaccgtcgcgatctgtctgtattccccggttgctgtatccagccggtaaatcatatatccggttactccgtccactgctttccacgtcagtttcacggaagaagtcccagttgcagaaacattcgtcagatccacctgacccggcagtgtcacatcactgtaaacatccgaaaaccggcccggaagtacatgatcattatttttttcataagcacggattttaaacttatattcgttcgcccccgtcaggccgcttatcgtataagaagtgcttccatctcccacgtcagctgccatttcatactgactacttgctgcactgtactgataaatctgataccccacagccccctgtgtttcttcccaggacaacccaagcgaagtctctgtccgcgtctgtgttgcgattccagcaaccttttccagcgaggtaatcactgaaaccggagaggaaaatgttccgtaataagcattcccccctatcgtccagtaacatctcactttatactgatagactttccctccttctgccgttgtgtccgtataactacagtcgtttgtcgactttagaagcgtatattttccctgatccgagtcgctgcgccatacctgataaccgtccacatcttctgccgaaacactgtcccagctgagattcacaattcccgaagtcccatccgatgctttcagtccggttatctgttcactggtatccttataccagaaattcacatcaaggactcctgtataaccatccacttccccttttgacgaatactgccagaattcgtaatcatatgccgtatccgcatatggtgtccctgactttgcattgcttgttgtggtattgttgtaccgggccatccacagggagcagtcatacagggtgtccgtattgatgtagtttttaatccatgcataggatgcatatacacctgcgcggtatccggctgccgtaatggtatccgcaaatgcctgacataccgctgtctcttttgttttggaaagttttcccgcagtcagacgcttgtttgcccctgcctcccggtccatgatgatcggcatcgacacattccagccgtactggtcaatcatatcgagcacatactgtgcttcctcccgtgcctctgtctcattcagagcctgggaaaagaaatacagtccgacattgatatcattggaaactgctccctgaatatgactgtctgcacaattatctctgtaaatacttccatctttcgtatctctggatgccacacgcacgaaagcaaaatcaattccggctccgtgaatactttcccagtccaatccggtctgtgtccactttgttctgtctttggaatactttttcttcagtgctgcatccgcctgccagtacgatacatcaattccgttgaccagttcatcatccgcatagtccgctttgtgataataggttgcgctggtataatcaccggccgtcgtaaaagacgcattcaaaaaagcactcgaatacgacgatgcttttttcaaggatgtccgattcccgaaaacaggtgcattcttttctatcagtgtatccagatccggctttgactcatacacggtctcatcctctatgctctgtcccatgacgccatccatctgcgcttcgggcacctgagcctttaactgctgtggcgccacaatacaaaccgccgtcaccgccagtcctgccataactatcttcgccttggtaaatgccaatttctgttcctccctctgttaccgttcaataaactactcattttacatagtaactttatatgattgtgcttgtcaatgttatttgccttgcaaaatctgttttttgcaaatttaagaaatccttaaataatattaagaaaaagagcacttgctttcgcaagtgctcctgttatacttatgttatcttaattgttagaaaattcttcgaactgcaagaatggttctgtaatttgcaggagaagtatatttaataccgtctcttgcattgcttgcatgtacaatcgtattgtttccaacatagattgcaacatgtccgctgtaacatacgatatcacccggctgcatgtttgatgtgctgacgccatatcctacacttcttaaagcacttgagctgtgtggaaggctgacaccgaaatgtgcgtatacagacattacaaatccggaacaatccgttccgtttgtaaggcttgtcccaccatatacatatggatttcctacaaactgtcctgcataacttgcaaccgctgatcctgttgaagatgcgcttgatgaatcctgtacggaagaatctgagctttgtgactgtgaagaacctgaagaggttgtctgagatgcactctctgctttctgtgctgctctgtccgcagcctcacgctcctctttttccttctgtaatcttgccttttcttctgcagcagactctgcatatgtgtattctgtagataatgtgacataatctgtagatacatagcctttgccttcatctacagaaacctttgcccatccatcctttgactcatccagtaccgtcagatcgtctccttccggcaccagagtaattacttctgccttctgggaagctcccttgcggacttttaatgtctctgtctctacaagagcaactcttcttcctgctttctttaattttttctcatcaccaatggatacgaattcagattttacataacctgttaccgatccagatttgattttgtaccagccatccttctccccgatgacggttcctacgttattcttatataattttcctacagccttgctgtctgtagttggtttcttacgaacgttcacgtaatcatccacaacagctaccgctttgtcttcatactcagactttacaactggtgcttcaacttcttttacttccggctgtgcacttgcaacggttgcctcatcttccactttttctgcgacttcactgagtgccagtgaaaatcctgcagtcggtgcagatgatgttgttgcaatatcggaagcaaggcttgcgactccagcagttggtgctgcgtaagctgctacagtaaaattgccaatggtcagtgccccaactaacccacatgcggtcaattttaataatgttttacgtttcattttcgcctccaatgacttttgtacttctttattacgaatttgttacaattattacattgtcattatagcaaaggcacggatatgtgtcaaccccttttccatccacagaattcaattgaatttttcgtatatttatgccataataaagatgtaataaagaaaaacacgtataccgagtattttaaaaggagatctgtcatatggatatttcaagtatcagttctgcgcttctttccgtaaacagttccgatcccggctctctggcaaatgccgtcagcattaaaatgcttgacaatgccatctcatcgaatgaatcgcttggtgttgggctggcaaaaatgatggagaactctgtttatcctaatttaggaagtaacattgacgtttccgtctaaccggaaaaagaaccgcaaggacaacaaaagagatctgtgcaatgcacagatctcttttcgtttttgatcttttctttattttacagcaatggcttcaatttcaagcataacatcttttggaagacgtgccacttccacacagcttctggatggaaatggtgacgggaaaaattttgcataaacttcattaattgctgcaaaatcattcatttccttgataaaaacagtggtttttactaccttatccattccggttccggctgcctcaagcagatttgacagattttcaaatgcctgctgcgcctgtgccacagatccttccggaatttctccggtagcagggacaaccgggataatgccggatgtgtataccgttccgttcacttcaatcgcctgtgagtacggtccgattgcggctggtgctttatctgtactgattacgtttttcattttatattcctccttttgcctttacctgcattatacgaaactcttgcggatttttccaccatccagtgtaatttttctttctttatataagtgtccgatggcacgtttaaacgcagctttactcaatccggtttccctcttaatcacctctggactcgctttttccgaaaacggaagcactcctgcataggaatccagcaattcaagtattttctctgcatccgtgtccatctgaatataagctttttcccgcagtgtaagatctaactttccatccggttttactgcagtaactttcgcctcaatcacatctccgattttcaggaaactgtgatcctctgaatttggtattcttgcggaaaagcaatcatccactgccacaaaagtaccaaagttatcagaaaactcatacacccttccggttaccatctgatctttctgatacggtgaatccttggaaagcagatcatacagccccttcatgctggcacaaagccgcttgcttttatcaatataaagggttacaagaatctcgtctcctgcttctacccgtgaagtcatctctttatatggcagaaacagatctttttccagtccccaatccagaaaagcaccgatctttccaacttctttcaccacaagcggtgcatattctcccagtgtcagcttcggtgtgttggttgttgcaatcagccggtctttggaatctttatataaaaagacccttatcttttcccccggttttgcatcttccggcacctgttttgacggaagcagcacatgtgtctcaccgcccatatcctctgccagatatactccgaagtctactttttttacataatacaaatcctgatattctgctaatttcatctttttcctacgctttcaaaaaacaacaactgcatatggctgcccatccggcgcacacagtgcaaccgtcacacggggatcttctatcgtcacatgcggcacaattacatctctgcacatcgcagcttttttatattctacccggacttccattgtccgaaactccttcggaacatattccatcgccacctgtacatatctggtattgttcatatggtgattggtatctatgaaataagaaggaacgaccaatgaatctttttcttcatatttttccggcagcataattttccgctcgctgcactgcatgggaagctgtggttccaatccgtatgcatccgagatttcttttgtcactctgaccggaatttccttctttgtatccatcagtacccatacggaatttgcatatgccatccgttccccatccctgccgttcatggagaaattccggtaaccgtaaaagcctttcattccatatgcccatgtctgtgtcgtaatctgttcgcccagccgcggcatccggttcagacagatctgccaggaagataagatccatgccttttgtgcatcggtccatacttccacaccaaggttcacggcctctgaatgaaatacgctgcaatcctgaaagtaatccataagcgccagccatgtcatccggccttgcgcatctgtctcactgtatcttaccctgctgtcaaattcgtacattaccgtgtcctttcttattcttatcttttataaaacaaaaagcactacataatgtagtgctcttcagctggcccaccaggattcgaacctggaaatgacggagtcagagtccgttgccttaccatttggcgatgggccaatgtgtttcatgtctcccaacaaatggtattatacatggaacccctataagtgtcaacccatattttcaaattttttcaaaaaaacacaacttctttatcaattagtgcatatacgcaggttttcccccattccagtccggcagatccgttggtcagttctgtaatctctttcggaagtatctctttttgttctgcaggtacgagaattatcatggtaacatccgcctcatatgccgtatccagaatcacagtgtgtttctgtccgaacagatactgcagctttccaagtccattataatcggtatgaaccaatagctgctgccccttacatttttctatgagccggctggctgcaagcccagcctgtgtggctgcctgataggcgcgtacaagccctcctgttccaagcagcacacctccaaaataacgtgtaacaacaaccgcaacatccgtaattttctcccggagaagtacatccagcatcggacgacctgcggtctgtgccggctctccatcatccgaacagcgcgtcagttcctgcctctccccgatgacaaaagcagaacagttatgacgggcatcccagtattttttctttgtctcattaatgaaagcaaccgcttcttcttctgactggacaggttttaccgttgctataaaatgagatttcttctctgtgatttcaccctctcctccggtatagaccactcgcatatatcctattctcctttgtatcattcctcattcttctccggtatctgttccggttcatgtgtttcttccggctttgcatcatccggtggatctgccggttcttcttccggcttctcctcatcctgcgtttcggcatcgtgtatattgcatgttccatttaaaaatttctctgtcgcacagtactggtaatcagccgagcccttttcggcacccacaatataagtttttgtcacaacctgatctgccggacagtattctccggcaacttttcccgatgcctcacagatctgcagagaaatatgatgatcacagttctcggtcggaaccgttccttctgcaaaatattccgtataactttgcgttccacgtgggtctttatcacagacatccgcttccggcagaagtccggattttgcacagacaacagcctgtgtaattccggaaggcttttcaaaatcttttgccttaagatctgcatgaatccgcttcatcacggctttccacaaattctttggatatcccgtagctgactgaatggaattgtcatcatatccgccccataccacgcaggtgtaataaggcgtaaatccggcaaacagtgcatccctgttcagcgttgtcgtaccggattttcctgcctgagccattccggttccaaaataagccctcatacccgttccactcgtcataacatctttcatggcatctgtcagaagccatgcggtatcctcttttattacctgacgctgttcctttatctgtgttttgtcaagaagaacattgccgtcatgatccagcacctgggtataaaaatttggttcgttatattctccctgatttgcaattgcagcataagctgcagtaagttccaggtttgtcaccccctgtgtcaggcctccgagagaaattccaaggtttctgtccgtatcggtcaacgtagaaaatccgaaattttctgcatattcataccccagatccacgccaatatcctgaagtgtttttacagtcacaatattgatggattttgtaattgctttccggatgcttgtaaaacctccgaatgtatgtgagtaattattatatgttttatttccgactgtaaatggtgcatcatcctgcacggatgccagcgtttttcccccggcatcaagtgccggcgcatagcatgcaatgattttaaaagtagatcccggctgccggcaggtctttgttgcacggttccaggtacggtttcccgccttatttccacgtccgccgacaatcgcctgtacctctccggtcgactgatccataatcgtcatcgccacctgtggctgcatggtaatgaaaatatactctgaattttctaccagcttgtcccctttcccgaggacatctttttcgtactgtgcaattgcagcccggcagtcctcctccgatgcaaaattgatcgaataattctgacttttgtttttctttttataataggaaagcattgtctgattggtatatgtttttattgtaccatccttctccttcacctgaaaagaaagatagaatgaatatttggtacccgcatcataattggctttgtctgccacctcctcatcgcagattttctggatttgaagattctgtgtggacttgatcgtcaatcccccctgataaattgccttgtatgcttctgactccgaatagcctttgatatttaccagatcatcaaaaacatcatcaatgaccgcgtccacaaaatatgtgttcatggtttcttccctcacatcattgtgttcggaaatcctgccatacacatcatctgccatcgctttatcatactgtttctgcgaaatatatccctgttttttcatggcatccagcacattctttctgcgctttgcattttcctttggatgaagaatgggattgtaacctgccggattctttgtaattccggcaataaccgcacattccgaaagtgtcagctttgacacatctttcccaaaataacgctgtgctgctgcctgaaccccaagggtattgcttccaaggttgatggaattcagataattttcgagaatccagttcttgtcatttacctttttttccagctctattgccagatactgttcctgtattttccgctgtacctgacgttccatcttttccattttggaaatattactgtcattttcgtttgcccactgctcactcagcacattatttttaatcagctgctgcgtaagtgtacttgctccctgactgaaatctctggtccggacatccgccaccagtgccctgacaattcctttcaggtcaataccgttatgatcataaaaacgctcatcctcgatcgccactaccgcatgctgcagattctccggaatctggtcaattgtcacgtactgccggttggatccggctgccactaattttgctgtctcacttccgtctgccgcaagcactttcgtggaatatcccgttggaatgacatccacttcggatatatccggtgcggatgcaagaattcctttaaatgcacccactccaaaactcactgtcgcacagcctcccaccatgattccaatcagtagaagtttccccagtatgactccgattttatgacgtattctcgttcctcttgcgtccagctgttttgctctccggcgcaaagaagttcttccatagttcatagttttctccccgcagaaataataaaaattcttttatccatatattataccaaataatatgtgcaatagaaagttttatttatcgacagcaaaaacccccggctttcgccaggggtccgctgttgatgtatactaaaactaaggggattagattcactaacctagccattagattagtgcaaaattattcaacatcctgtaaggcttccatatcttcctcaccggtacgaatcttgacaacctttgccacatcgtatacgaagatttttccatctccgatatgtccggtataaagtgccttctttgctgcagccactacgctgtctactgggatcttgcttacaacaacctctaccttaatcttcggaagtaaggttgcatcgacttcagcaccacggtaacgctcgccggagcctttctggataccacaacccataacctgtgtacaggtcattcccgtaacacccagatcgttcattgctttcttcaaatgatcatatcgggaaagctttgcaataataaccactttgtacatgccggttgcatcctttggcacggcggaaaccaccttgactgctgcatctctctttgccgtagaagcctgtgcatattccggtgtacccagatctgtattttcattgacatccatggtcattgtgttggaaacatccatgatggagaatcctgagtaagcagatgcaagtccatgctccatggaatcaagaccgacaatttcttcttcctcgctcacacggagtccaatggtcttcttaattacaacaaatgcaatcgtaattgtaactgcggtccatgcagctaccgtaacaaaacctaataactgaataccaagctgcttcaatccgccaccatagaagagaccaacaaccgagtcatttcccggagcagatttcgtagcaaataaaccaacggcgatggtaccccagataccattcatcatatgtacagctaccgcaccaaccggatcgtccacatgaagcttataatccaaaagccatacaccaaagcaaaccagtaaaccggaaacaaaaccaatacagattgcaccgaaacaatcggtcacgtcacaaggagcggtaattgctacaagtcctgcaagtgatgcattcagacacattgatacatcaggtttaccatatttaagccatgtaaagatcatacatacaactgttgcaactgccggagctacggtcgttgtaagaaatacgctggcaagctgtgaaccggaagtacatgcagcgccattaaatccataccagccaaaccagagaataaaacatccaaggcatccaagtggaagattgtgtcccgggaatgcgttgacttttgtaatcttcccagacttatcttttgagaactttccaatacgtggtccaagcattgctgcaccgatgagtgctgaaataccaccaaccatatgaatggcacaggaacctgcaaaatcgtggaatccaagctgtgataaccagccgccgccccagatccagtgtgcttcaatcggataaatcaatgccgaaattactgcggaataaatacagtaggataagaattttgtacgctctgccatagcacctgatacaatcgttgctgtagttgcacagaatactaagttaaacacaaaattcgaaaaatcaaaatttgcataactggtaaagatatcaaatcccggttttccgataaaaccaagaacatcttctcccagcaataatgaaaaaccgatcaggatgaacattacggtaccaatacagaagtccatcaggttcttcatcaaaatgttgcctgcattctttgctctggtaaaaccggtttctaccatggcaaagcctgcctgcatccagaataccagtgcggcaccgatcagaaaccagatgccaaacatattttcattgataaaacttacaatttgttgtttatccataacaatctcctccctatatagaaaaagagacacttccccaaattccacagcttcgtggttctgaaaaaatgtctcttttttattttgtaagatgtttgtaaaaaatgttccttaaatctttggattaaacttcaaagatcagatctccataagatggcattggccataaatccttgtcaacgatcatctccagcttatctaccggtgcacggagtgcatccatagcagatttcacctcatccctgtaatatacagcctgttccttaccttcacccatttctgttccctttgcagtaacagtttccagactcttgagtgctttctgtgtctcagcaagcagggaggatgtctctgtcaaaatatctgtctgtgcgctgacatctgcagatgcacatgcactctttacagttgcaattgactgtccaagttctgttgtgtacttgataacagccggaataatctgctttccagcgatgtcaatcatggcttttgcttcgatattgatggtctttgcatatgtctcgtactcgatctctacacgggattcaagctcagacttggtaaatactccaaatttttcaaatgcagctacagattccggagctgtatatgcaggaattgcatctaccatggacttgatatttggaagtccacgcttctgggcctctgcaacccattcctcagagtatccgtttccgttgaatacgattctctgatgttcgatagcatatttcttgatcagatcatgtgctgcaagctcgaaatcgtctgctttttcaagaacgtcacaggcatctgaaaatgcctccgcaacgatggtatttaacacgatatttgcctgtgcaacggaatcctgggaaccaaccatacggaactcaaatttgtttccggtaaaggcaaacggtgatgtacggttacgatcagtcgcatccttcatgaaatccggaatggtcttaacaccggtttcaagtttttcaccttccagactgtgtgttgctgtacctgtgctgatcagctgatttaatacgtctccaagctgatctccaaggtaaatggacaggatcgctggcggtgcctcgtttgctcctaatctgtgatcgtttcccacatcagctgccgctgcacgaagaagtgctgcatgctcatcaactgcctttaaaatacaggtaagtaccagtaagaactgtacattctcatgtggtgtcttaccaggctcaagcagattgattccatcgtctgttgtaatggaccagttgtcatgctttccggaaccgttgacacctgcgaatggtttctcatgaagcagacactgtaaaccgtgacgtccggcaaccttctttaaggtttccataataatctggttgtgatcaactgctacgttacactctgcataaattggtgccagctcatgctgtgccggagctacttcgttatgctgtgtctttgcagctacgccaagtttccagagttctttgttgacatccttcatgtaggctgcaattctctcgcggattgctccgaaatagtgatcgtccatctcctgtccctttggaggcattgccccgaaaagagtacgtccggtaaagatcagatccttacgctgtaaatacttctgacgatctacaatgaagtactcctgctccggtccaacggaaggggtaactttctttgatgtcgtatttccaaacagtcttagcagacggatagactgtgtatcgattgcttccatggaacgaagaagtggtgtcttctgatccagtgcctctcctgtgtaagagcagaaagcagttggaatacaaagagtggctcctgctgcgtcctgacgaacgaaagcaggtgatgtacaatcccatgctgtatatcctcttgcctcaaaggtcgcacgaagtcctcctgacgggaaggaagatgcatccggctcgcccttgatcagttctttaccggaaaagctcatcagaaccttgccatttggcattggcgcagtaataaaggaatcgtgtttctctgcagtcacaccggtcaatggctgaaaccagtgggtataatgggtagcacctttctcgatagcccactccttcatctcatgtgcgatgacgtctgcggtctcaagatcaagttcttttccctcatccatgacttcatggagtttcttgtaaactttttttggaagacgttcctgcatgaccgtgtcattgaatacgttctcgccaaaaatgtctgcaacgttaaaataatcactcattttttacaacatcctttcttttcacaatcaaatcccctgattgtacgcttatttaccaaacataagtcattttactaaaaaagggcattccaatagctatattggaacgccctcgttcttaactcatgtttaatctaaaactaagatacctctttccaacacaaaatgcaacctcttttttgaagttttttacattttatacaatttgacgtttttctctcaaattctacttcttttttgtttatttcttcacgaaaaaaggaagtgtcaaacggcacttccttttttgattcctgttattattcagcttttccaacagaaccgaacagttccatcttttccttaacagtagctttgattgcatctgcaccaggagcaagaagcttacgaggatcaaatcccttgccctctaagtccttaccagcctcaatgtatttacgtgtagcatctgcgaaagataactggcactctgtattaacattgatcttagatacaccaagagagattgctttcttgatcatatcagccgggatacctgtacccccgtgaagaactaatggcataacaccggtcttagcctggattgcatcgagagtctcgaagcttaatcccttccagtttgcaggatattttccatgaatgttaccgataccggcagcaagcatatcaacaccaagatcagcgattgtcttgcactcgtccggatctgcgcactcacccataccaacaacaccgtcttcttctccaccgatggaaccaacttcacactcgatagaaagtcctaagttgtgtgctacatttactaattctgtagactttgcaaggttctcctcaaatggataatgagatccgtcgaacatgatggatgtgaatcctgctttaatacacttgtagcatccttcgtatgttccatgatccagatgaagtgctacaggaactgtgattccaagttcctcatccatagccttaaccatagctgctacggtcttgaaacctgtcatgtacttaccagcaccctcagatacaccaaggattacaggactctttaattcctgtgcggtaagaagaatggactttgtccactccaggttattgatattgaactgaccaactgcatagtggcctgcttttgcttttttgagcatttctgttgcagatactaacatttgtatttcctcctaatcataagttacctagattatagtacacttttccccaaaaataaagttaattttttaacaaaatatttcaactctctgcttcaaatttcggatgactacttcccggtgtgctccgccgaattcaccgtcgagtgtccacggtacttcttccttcgccgtaatgtgtacagcatcggttttaaacgaataaatcagatccgaatcatcaatcatatttgtcaggcaggcaaggatttcattcagctcaatcggattcttcggattgcggatcaaagtcacttcaaacaaaccgtcatcaagttttacatcatttccggtcattcccttaaagcccccgacagaaacggaattggtaaccattccgtatataaattcatcctgaaacacttttccgtcatattccacctgcatacggaacgatggaatgtcccgaagctgtttgacaccctccataatatacgccacgtgcccgaaaatatttttcagctgctgggatgtcttataggaaacctctgtaaacagaccaaacgctgctacatagacaaaggtatccgaattgaaatctccgatatcgcatggaaatctgttttgtccaaccgcccgctccgctgcctttagcatctccttcgggattccgagagaattggcaaagtcgtttgtacttccggccggaatatatccaatcggaatatgcagcttcgcctgcatcagcccggtcatcacttcatcaagtgttccgtcacctccgctgcagacaatacgatcatatcccgcaccctcttccaccaccttgcgcgttgcatctgcctgtgcctgtgtggtataaattgtcacgtcaaatcctgccttcaccatcatgtccacaatatctacaagatgatttttaatctgtccttttcctgcatgcggattaaaaataaataacagtttctggctcatacgtagttcccctttatataagattttctgcaattgcggcaagtttccgtaatctgtgattcacaccagattttccgaccggtggatcaagataagttcccagttcctttaaagttgcctcgggataatccagacgtgcctgtgcaatctccgccagcggttctggaatgttgtcaaaccctatggtatcccggatcctcttgatatcttccatttgtttaactgctgcattcaccgttttgttgatatttgcagtctcacagtttaccttgcggttcacagaattgcgcatctcctttaaaattcttacattttccagattcatcaaagatacataagcttccatgacattcagcagatccacaatctgtgaaccttctttcaggtaaaccaccatacgctctttgcgttctacaatcttaggctccgtctcaaaaaattccatcagttctttcagctgctgtgcctgttcaagcgtatggcagacaatttcaaaatgataggatttattcggatcactgatcgatcccgctgccataaatgctccacggataaatgctctcttacagcatgtctgctgcaccagcatcccatccgctctccggtgatttattttccgggaccggtacggttcctgatcccagtgcagcgtctgcatgatctgtaaaacctcctgtttctctccaaatattttttgcaacagcagaccgtattttgtctgcagcaaagaattttcgttggaaactacaagctttccctcttcatccaacatgccttccagttccagtattcctgccagttctgcgatctggcaatgtctgctccgtccgaactgttttgccagttcctcttttacttcactcgaaaacgacatcctattttcctctcagcgcatctttcccgatatcgcgatgttcaattttcaatccgtattcccggttttttttctgactcagacgcttgtacaattcattggcaagtgtgacggaacgatgttttcctccggtacatccaatggaaattaccagctgattcttgccctcggaaatatagtgtggaatcagaaatgtcaccatatcttccagcttgtttaaaaagatctttgcctcatcatatttcatgacatactgctggatttccacatcatttcctgtcttcggacgaagttcttccacataatacggatttggcagaaaccgcacatccatgacgatatcagaatctgccggaattccatacttgaatccaaaagaaaggatcgtaacatacatgctgttaaattcttcatcctgcacaaagatcttttccagttctgtttttaattctctcgtaagcagacggctggtgtcgataatataatccgcttcttttttcagaaattccattttctgacgttcccgcatgattcccttatccacacgctctccctgtgccagcggatggcttcttcgggtctctttatagcgttttacaagaaccgtatcctctgcatccagaaacagcacttcatactggacatccttactttttaaaatttccagcatatcctgcactttatccagattttcaccgctccgcgcatcaattccgatcgccacatttttcatctgcgtatcaaaatttgttgcaaaatccacaagtttatccagaagcggaatcggaagattatcgatacaaaagaatcccatatcttccatcattttcattgctgtactttttccggctcctgacatgcccgtcacaattacaaatctcatctagaactctcctatcattttcacttccggttcaagtgtcacaccagactgttttttcacacgttcctgtacatctttcatcagctgcaaaatctctgctgcggtggcatttcctctgtttatcacaaatccgcagtgtttttcggaaacctgggcatcccccactgcatagcctctcagcccggcatccataatcagttttcctgcaaaatagccttccggacgcttaaacgtactgcctgcacttggatactccagcggctgcttctccacacgtttttccctgagttctgccatctttgcacggatctcctgctccggtgccggcgtcagggacaactctgcctccagtaccagaaaatgattcttgggaatacagctgtgccggtaggacagatccagttcctcccgtgagagtaccttttgctcacactccggggtaagcactgtcacctgccggatgacatctttcatttctccgccataggcacccgcattcatggtcactgcaccgcccatgcttcccggaattccggcagcaaattccatgccgcccagaccggcagctgccgcttttgcagccacctgggaaagcagggcacctgcctgcgcacgcaggatatttccctgcacttccaccgcattcatctgtgccccgacttcaataacaagtccacggattcctttgtctccaaccagaagattacttccgtttccgatcactgtcactgcaagccctttctttttagccaggccaagaattaccggaagttcctgtttctttggacacacgtaaagatccgcaggacctcccacgcgaaatgtcgtgtgttttttcatcggttcctgctgatatacgaccagctcaggcaatgccgccctgatttcttcaagccactgatccattatgcctccttcaggaaagccacatagccgtacaatgcctcatacagatccactttgctgatgatttcccatggtgcatgcatattcagtacggcaactccgctgtcaataacattcatgccataatttgcaagaatatatgcgatggttccgccgcctccctgatctacttttccaagttctgatgtctggaacgatacatcattatcatcaaaaattctgcgcagtcttgcaatatactctgcatttgcatcattggaacctgattttcctctggctcctgtatatttgttcaggacaagtccctttccaaagtaagcacagttacgtttttccatcacagacggataattcggatcaaatgccgcagatacatcggaagaaagcactctggaattatgcagcgctctgcgcactttcaattcgctgtattccccaagcagattgatgatctctgccacactgtcctcaaagaaatgggactgcatgccggatgcaccgacacttccgatctcctctttgtctaccagaagacatacgctggtatgctgtggcttttcaatctcaagcattgccgcaaaagacggataagcacacactctgtcgtcatgtccgtatcccatgatcatgctgcggtcaaagccgtaatctctggcagcccctgccggaacaacttcaatctccgcagacagaaaatcttcctcgtccacaccgtactctttggacagaatatttaaaatatttgcctttacgcggtctttcatctcttttttctctttttcatcatcacttgctgccggaatacttccgacaagcagatcaaggttttctccttcgatcaccttggatgcctttttctccatctgttctcccgctaaatgaatcagcagatcactcacgccaaaaacaggatcttccggtttttctccgatattgaccgtaaccgttgtaccgtcttttttacagattacaccgtgcagtgcaagtggaagtgtcacccactggtatttcttcacacctccataataatgcgtatctaacagtgccatctccgtatcttcatataacggtacctgttttaaatccatacgtggggaatcaatatgtgcgccgagaatgttcattccttcctcgatgtctttttcaccgatcacaaacagagcgagaccttttcccatattattggcaacaatgcggtctcctgcttttaattttgtattctgcgcaatcttttcactcagatctgcaaatccagcttcctttgcctgccggtagaattccgctgcacactcgcgctcagtcttgcaggaagatataaacttacggtattcttccgcaaatgtaaatacatcctgtcttttggttccttccgggtatttctcccacgcatttttcttttccatgatttcttacatctcctcatttactctcgtctattcttcatcgtcactttttgtcatatttgcctgaactctgcgatacagttcctgtgccgcattgtagcccatcttcttctgtctgtggttgacagccgcagtctcacagataaccgccagattacgtcccgggcggattggaagggaatgacatactaccttattgcccagatattcgatatattcttcttccagtcccaggcggtcataatccgcatctttcttccagtcttccagtttgatcaccagatcgatctgctgcttttccttgacgcactccacaccatacagagtctttacatctatgatgccaatgccccgcagttcaataaaatgccgggtcacttccggagaagttccgatcagtgtatgttcattgatcttgcggatttccactacatcatccgtaaccagacgatgtccgcggcggatcagttccagagccgcctcgctttttccgattccactgtcacctgtaatcatgagaccctcgccatatacatcgaccagaaccccgtgaacggtaatacagggtgccagttcttcacccagtgtatagatcagctctgccataaattcagaagtcggacgatccgtaccaagaaccggcacttcattttttattgcctcttctaagaaaatttcatccggctgcagactgcggcagaaaatcacacatgggatatcaaacttcagaaacgcatcataacgggttttcttttccgcatcactcatctgctggataaacgtatattctacatttccaatcatctgtattcttgattcttcgaaatgttcaaaatatccggtcagctgtaatgccggacgattcacatcgctggaaataatcttacattttttcagattgatatccggcgtaaaatttttcagatttaaaacctgtgcaacttttgcaacactaacacttccatttgacatattcatttccccctgtggctcatattaagcagtacctgtgccggactgcctttttataaacagattgtaccatgaatcttcccatatcacaagttgctaagccggtccggaatgcagggtatcatatacattctgtgcagccgccagattcatgctgtcggtttctgccagttcctccacagatgcgtttttcatattttccatagactggaatctccgcattagtgcctttcttctggccggtccgattccctcaatgtcatctaaaatggagtgtacctgtgccttggaacgcaaagaccggtgatactcaatggcaaaccggtgtgcttcatcctgaatccgggtaatcagtttaaatccctctccatgccggtcaatcggaatttccacattgtggaaatacagtccccttgtacggtgattgtcatcctttaccataccgcagaccggaatatccagtcccagttcttccagcacctgcagacagatatttacctggccgcgtccgccatccatcataatgatatccgggaagcgtgtaaaacttccgacttcctgtggcatatttttttcttccagttctttctgttcctgcatgccgtgcgtaaaccgccgggtcagaacctcatgcatggaagcgtaatcatccggtcctgataccgtacggagtttaaatttccggtaatcgctcctctttggccgccccttttcatatacaatcatggaaccgacggtttcaaatccgttgatattggaaatatcgtaagcctccatacggtttaagtctttcatgccaagcagctgttcaatctcttttaccgcgccgattgtgcggccttcttctctcttgatcttttctttatcctgactgagaaccagctgtgcatttcttgcagccagttccaccagtttttctttcagtcctttttgtggaattcttatcgtcactttccgcccacgttttgcagtcagccattcctccagtactggaatgtcttcgatcgcctcctgcagcataatctcccgcggaataaatggcgtgccggaataatactgtttcacaaaatttaccagaatatctcccgtgctttcttccgatcccacgcgcacatgaaaatgatcccttccgataatctttccactgcggataaaaaacacctgaaccaccgcatcccggtcatcactcgccagtgcaatgatatctttgtcttctccgtccgtattggtaattttctgtttctgggcaatctggctgacactgtttaacagctcacggtattcgatcgcccgctcaaactccatctcctcggaggcttcctgcattttttcttttaattcacacagcaccggcgcataatttccatttaaaaattccagtgctttgctgacctgttttccataggtttctttatccacatatccctgacacggtgcaccgcactgatgaatatgataattcaggcaggcacggtccagcccgatgtcccgcggaagctttcggctgcaggtgcgtagtttataaagtttattgatcagttcaatcgtatctttcaccgcaccggcactcgtatacggtccaaaataacgggacttgtcttttttcacctgccgggaaaaaagaacccggggaaaatcctcctgcacggttacccggatatacggatacgtcttatcatcccgcagcatggtattgtatttcggtgtatgttccttgatcagattgcactcaagcaccagtgcctccagttcggagtccgtgataatatactcaaagcgtgcaatatgctccaccatctgttttttcttgattccctcatcatggctaggctgaaaatactgccgtacccttttgcgcagactgactgcttttcctatatatatgattgcatctgttttgtcatgcataatataaactcccggttgatccgggagtttacgcaattcttcctgaaagtcgaacatgatttaatcctcaaacatatcatcactcacaaatgcggctttggaatcctttttatccttctctgtgtcatccggcatcagggcttctttatcctcttcttgcggaagtcctttcatctcgcggaaaatcttcatgaattccttgccggtaatggtttctttttcatacaggtattcactgatatgatcaagaatttcacgattttccgtcagcatctgcattgcttcattgtaactgctattaataatagaaagcacttccttatcaatctgtcctgccgtgtcttctccgcagatcagaccggctcttccatccagatactggttttccaccgtagcaagacacatcatgccaaacgtatctgacataccgtacatggtgaccatggcacgcgcgatcttcgttgcattctcgatatcgtttgctgcgccgctggttgcggaatggaatataagcacttctgcagcacgtcctgccataaacgttgtaatctttgcaagcagttcgtccttggtttctaaatatttttcctcttccggtgtctgcagcgtatatcccagtgcccccatcgtacgcggtacgatcgtgattttctgtaccggctccgtatttttctgcaaagcagataccagcgcatgccctacctcatggtaggagacaatcttgcgttctttatcactcatcacgcggtcttttttctcttttccaccgacagccacaagttcaaatgcttcaaacagatccgactgattgacaaactttcgtccattctttaccgcattgatggcagcctcgttaatcatattggcaagatccgatcccaccagaccggcagtagccagtgccagtgcatccagatctaccgtttcatccatgtgtacatccttggaatgtacttttaacgtttccagacgtcctttcagatccggcttgtcaacaatgatccgacggtcaaaacgtcccggacgaagcagtgccttatccagaacttccggacggttcgttgccgcaagaattaaaatacctttggatgcatcaaatccatccatctccgcaagcagctggtttaaggtctgttcacgctcatcattgccaccgccataccggctgtcacggcttttaccgattgcatcgatctcatcaataaaaataatacacggtgccatcttctgcgcttccttgaacagatcacgcacacgggaagcacccatgccgacgaacatctccacaaactcagaacctgccagggagaaaaacggaacctttgcctctccggcaactgcttttgccagcaatgtcttaccggttccaggaggtccgacaagaagtgcccccttcgggagctttgccccgatatcgctgtatttcttcggattgtgcagaaaatccaccacttcctgcagggattcctttgcctcgtcctgtccggctacatctttaaatgtcacaccggttgttttctccacatatactttggcggttgattttccaacccccatggctcctccgcccatccggcgcatcaggaatccaaaaagaatccagatcagtaccagcggaataacaaagcttaaaatgtttaccagccatgccgaagtattgtccggcacggatgccgaaatttcaatcgctttcccctctgatgtctttgcactcttgagtgtcgtgatcagatccggatcattgacaattccggtgtaatatgttatctcatatggttttttatcgtccaccagtgtgtaatccatctcataattgctgaattccaccgttttgacattattcttttccagctgttttaggaattcggagtatgtagtttccttcgaactcatctgtgaaaaccggttggcaaaaaatgacaggaaaaagagtgccaccagagtgaccatgataaatcccaggatcatctgtccgttatggttgtctttctttcctccgttgttgccaccgttgtttccgttattaccattgtttccgttgtttccattatttccgttattataattattgccaccgttatagtttccgttgttataattattcggtgcctgattgtccataagccctccacttgtatatctcttgtaatcaatacccttattatatgtaataagaaacgcaaaatcaacattttgttcgagaacttttcctatcctttctaaactttttataaaaaagtatggaatattttcgttgtccgctgtataatattaaactatggtagtttagataaaaacttaggaggaaaattatgcctgtaaaatacgtctttgtcactggcggtgtcgtatctggtcttggaaaaggtatcactgctgcatctttaggacgtctgctcaaagcgcgtggctacaaagtcaccatgcagaagttcgatccatatatcaacattgatccgggaaccatgaacccgattcagcacggtgaagtgttcgtaacggatgatggagcggaaaccgatctggatctcggtcactacgagcgcttcatcgacgaaagtctgacaaagaattccaatgtgacaaccggtaaggtttactggtccgttctgcagaaagaacgtcgtggagattatggcggaggaaccgtacaggtaatcccgcatattaccaacgagatcaagagccgtttttaccgtaatttcacatccgatgatatgcatattgcaattatagaagtcggcggaaccgtcggagatatcgaaagccagcctttccttgaagcaatccgtcagttccagcacgaagtgggacatgagaatgcgattctctgtcacgttaccctgattccgtacctgcgcgcctcacaggaattaaagaccaagcctactcaggcaagtgtcaaggaactgcagggtatgggtatccagccggatatcatcgtctgccgttccgagcagccgttagatcagggattaaaggacaagatcgcactgttttgtaatgttccgaacacacatgtactgcagaatctggatgttgagtatttatatgaagctccactggcgatggaaaaagaaaatcttgcgaaaattgcctgtgagtgtttaaatcttgactgtccggaaccggatttaagtgactggaagtccatggtcaatgatctgcgtcatccggacaaggaagtccggattgcactggtcggaaaatataccgcattacacgatgcttacatttccgttgtggaagctttaaagcacggtggtattccagagcatgcaaccatcgacattaaatgggtagactccgaagaattaaatgtagacaatgtagatgaggtgctgggtgatgtaaacggtatccttgttcccggcggattcggtctgcgcggtgtcgagggaatgatccttgccgcacgctatgcccgcgagaacaagattccgtaccttggtctctgcctcggcatgcaggtatccatcattgaatttgcacgtcacgtatgcggattcaacgatgcacacagtatcgaacttgacccgaacacaacacatccggtcattgcactgatgccggatcaggacggtgtagaagatatcggcggtaccttaagactcggcgcttatccttgtgtactggacaaggattccaaagcatatgaagtatacggaaccactgagatttccgagcgtcatcgtcatcgttatgaagtaaacaatgattatcgtgccactctcaccgagcatggcatgaaactttgcggaacttctccggacggaagaattgtagaaatgatcgaactcccggatcacccatggtttattgccacacaggcacatccggaattaaaatccagaccaaaccgtccacatccactgttccgtggttttgtggaagcagcaaccaagtgtaaacgataatgtaattcccggcggtttttccgccgggttttcactttatttgaaagaggagaactgtcatgcccaaatctgtgaatcaaaaacaaaagctgttattccttctggattatctgcgtcagaacacggatgaaacccataccgtcactaccccacagatcatcgaccatctcgcggcaaacggcatccgggcggagcgtaaaagcatctataacgatatccagacgctttgtgattatggttatgacatcatccggaccgaaggcgcgcatgccggttaccgcatagcagaccgcacatttgagctgccggaagtcaaactgcttgttgacctggtacagtcttccaaatttattaccacaaagaaatcacggcagctgattggcaaactggaacagcttgtcagtaaaaacgatgcgaaaaaactacagcgtcaggttgtcgttgcagaccgcaacaaaaccagcaatgaaaaaatctattacagcgtggatgtcatccattctgccattgcagaaaaccggcagatccgtttccactacttcgactggaatgtcagaaaagaaatgcagctgcgcaaagacggcagattctatcaggtcagcccctggcttcttacctgggatgacgaaaactattatcttgttgcctatgacgcggatgccgggaaaatgaaacattaccgtgtcgacaagatgcttgatctctccgctgtggatcaggcgcggtgcggacggaccgattacgaacagatggatatcgcctcttattcccgcaaaaatttcggcatgtttgccggggaagagacaaccgtacagcttctgtgcgatacttccatgaccggtgtcatcattgaccgctttggtgccggtgtagccatgcgcccctacgacgaaacccacattctcgcgcgggcacaggtcgctgtcagtccacagtttttcggctggcttgccggcttatccacacatatccgtgtgatttccccggattccgttgtcaatgaataccaaatttttctgcaggaaatcctgcgcagttataccgatatgcaataatcgtttccaaaggaggaatatactatgaatttaccgaaagatcctgtcatgcttctgtctgttgtcaacacacagctgcgtgatcattacccgacacttaccgaacttgctgccgcatatatgacagatgcagatgcaattacagaaacccttgctgccatcaattatcattacgatgaggggcagaatcagtttatttaacaggcaatcgcctgattcacttcataaaaggaggggaacttttgtatggccagttgtgatttttgtgcatacaatgaatatgatgaagaggacgaagcgtactactgctccgtcaatatggatgaagacgacatggctcgttttgtccagagtaattacaaagaatgtcccttttaccgttccggggacgaatacaaagttgtacggcaccagatgtaacctggtgccgttttcgtaaaatactaattatattatgtttctgcccacacatccatggatttctttccatgctttcttccccagagatacaacagcacacaggcagccaaaagtacaatatccgcaaggagcgttccctcgataccaaatccaacgttgtatgcaaaactgtccctggcggttgctgcatccagtttaaataccgaatacggcacattgatcccactgtttggcaagccaaagagaatgttctgcgtaaaattccatgctgtatgtacggcaaacgcacaccagagactgtccatgtaatataccatgagggaaaacaaaattccgacaagaaaaatattcaggacagaaagcaccgtaactccgtcattcgccagatgcagcaacgcaaacagcagtgcatttccgacaattgcaaccaccggatttttataacttctgcgcagtttctgatatagaaatcccctgcacagcagttcctctgccgacgactggataaacacggtcagaaacacaaccacaaaccacagcggatgaatggcatcgtaggtcagcacaatatcatggtgcagccatgcaatcagaatacaaaatccattcagtgcaaatcccagaaccaaaccgaaaagcagatatttccagttatttccctgtggtttcgtgccgactgcctgtaaaatcggacgattccgttttcggataccgatccagaacaatgccacggcccagattccccaaaagatcacatacatcagtgtcgtattcaaaaacgcagaatttagtatctcagggtttcttgcataggcaatccccaccgggattccgagaacaaagtttcccagaaattgtcctaaaaccatgagaatcacagtttcaaggtaaagcaccggaagcgtatcaacaattttgtttttcagcaattttttcttttccatttgactgaaactccttttcttttatctgtttccaattatatctttgtacgcttaatgttttacctgttgtatcttaacgttttcttaaactgccgtttaacgaagacggaagtctattggttttatccacactatttggtatctttatttcgatgtaccaattttgcctgccggttgatcagacgtccgatcagttctaccgactcatcaattccgtagcatgcactgttgatacacagatcataattgatcgcatcaccccagcgcttaccggtaaaggaatgataataatcctggtgcttatgatccatcttgcgcaccagattaatggcctgtttcaaatccagatttttcagttccatcatacggcgcacacggatcgcaaacggtgccgtaatatagatactgatatgtggaatatgctgtccggtcagtacgacatccgcagcacgtcccataacaatcatatcttcctcttttgccagctcacagattaaggcactctgccggaagaaagatgcgtctttctttgacagaccatgataacgcttaaaatcgctgacttttgccgcatctgccccgaattcttttgcatctctgcgatctagaatctgattcaataccgattcatcataataattgatatgcagtgcttccgccagtgcaaatccaatatcagtacctgcacttccatgggaacggctgatacaaattaccagatgatccttctcagaaaacttcttgctcagaatcgaagaattcatatctgccagatctttatccacaatatctaccgagccaaagctcatcggcagatttgctatttcttccagaatatcattatattcaaccaaaaggtcatggcgtgcttctttattccggatacttctcgccatgtttccgatcagagccagttcacttcgaagcaaatgcccctgtggattggaaacaataagcatggtcaggtcatccagcacacgcgctttttctccggtaaatgtctttccgagtccagaaccggaagtcttgtacaccttttcatccagttcatagatgcggttcgccagctttctgcattgttctttgttgtccatagccttctacctcctataaaaagaataccagtgtatcaatgataaataccggaatcaaaaacttcagggaacataacatatagccaaagaatgacggcatcttgataccgttttcatccgaaatggatttcaccataaagttcggtgcatttccgatgtatgtgttggctcccataaataccgcaccacaggagattgccataagcatcttgaccgcaacggttcccacggttgtagcaataccactggttgcgcccagtgttcctgccgttgtaaggaataccagataggttggtgtattgtccaggaaactggaaagtgcaccggtcgcccagaacatctctaaaggttttgtcagtcccagttccgcacctttgctctttaagatcatgagtgccggctgcatggtaacaaaaattccgataaacagtactgcaacttcctcaatggcgccccaggtaaagtggttctttgtgcgcacatcggatttcgttgtcttaaatgacagaaacgctgcaaccagaataataacaatctcgatcagtgtcggcactgccagtcttacgctctggaaaatcggaatactgatgacgcttccgtctgcattctggaatgctttcattcccggaagaacgccgcttaatacaacacctgccacaatcataatcataaaaatgatgttgtgcagaccattgactttaaaagtagtcgttggcctggaaatatccggacgcatgccaagtgcaatatctctgcgatatgcacgacggtcgataaaataaaatacggtcaggagaattaccatattaaataccagtaccgggaacagacgtaaactccaggtaaacggtacacctctcataaatcccatcagaagtggcggatcaccgattggtgtcagacatccacccatattggaaatcaggaaaatgaagaagaccataatatgactcttatttcttctccaggaattcatctgaatcatcggccgtaccaaaagcatgctggcaccggttgtaccgatacagcttgaaagcagtgttccgatcgccagaagtccggtattcatacgcggtgatccgacaaaatctccttccagattaatatttccggaaacacaaaacagaccaaacagcaatacaataaaggaaagataatcattcactatacattccagaactgtttctgcagtctcgcctgcgccgtattttactgcaaacggaataataaataaaagtgaccagatgagtaccgcccagcctttatttttgtcccaccattctccttttaccagtgggaaaattgcgatacataataaaaggccggcaaacggtatgcacagccaaagcggtatgttacccattttcttgtacctccttataatctctgtatattttacacctcagcccccaaaaaagtaaccgctaattcgtcaaataattaacaaagttccaatctccatttcacttatttttgtatattttctccatataaagaaagcctgcatccacacggtgtattttatttcacaggcagcattttgccacaaaatgaagagaagcctctccgttcccggatcggcttctcttcgaggagtttagttatgaaaatgtttattaaataaaaagggaataatgtaaaggaatgatttccgtttacattgtctagtatatgcaaaaaatgtgtccatattatgtccacttcaaaaacaaattctaaaatcatattccaaaaattttagagacattttatatatttaacaatttcttacataattcgatcttgctgtcatcggtcagactgttttcaaataccacctgtccacgtttctgccggccgcaaagcagatctttctcctgcagtcttcttttcatctcgcgtgcggttccctcgcctccgtcaaaaattttcacattctcccccaacacctgctgaatctgttttctggcaaacggataatgtgtgcagccgagtaccgctgcatccacctggttttcccggtaagaataaagcagatcttccagatatttataaagatcctctccgtcgagatctccccgctcaataaaatccatcagccccggacacggcaacggaagaatttgtgctttctctttgtagcgctccatcagcacatgaaacttttcttcatgaattgtcatcggggttgccatcacaaggactttgggatgttccatgcaaagtgccgccggtttcagtgccggttcaatcccgacaatcggaatatacggatacatctcgcgcagtttccggacagcagcactggtggctgtattgcaggcaaccacaagaccttttgccccctggtcaaacagctttcgtgcacatccgatcgtcagttcccgtactttttctttttcttttgttccgtatggcgcatttttagaatccccgaaataaataaaatcttcctccggcataatccggatcagttcccgcaggacactgattcctcccactccggagtcaaataccgcaattgggttttctctttgtaattgatattccacagatctgttatcctttcttaattgaaaaaacatggttcagttgttataatagtaactagtaaatagcaatggagagtgacaactatgctgactgaaaaaaatatttccgataaatataaatactgtgaattttgcggacgcacgcttccaaaacattatgaaggaacgctatgtcccacttgtcaggaagcacagcttttccggaatgtgcgggattatatccgcgccaacactgtaaatgaatatgaagttgcagaacatttccatattcctctccggcagatcaaagagtggattcgggaaggccggatcgaatatcatgaggtcaacacagcttccactatctccggcatgcactgccagcgctgtggtgctccggtttctttcggtaccctgtgtccgaattgtctgaaactgatgaacacacagggcagatccgttgcccctgccatttcaccggattcacgcatgcactatctcgataccccttctgacaaaacgaaataagaactatccactcacaggaaagggatgccggatttcggcacccctttttcttacgcctgtgtacttctgcgaattactttttgtctgtatttaaactccactgcttccagatatttatcatccggttcaaatttgatcagcagtgtctcgccttcctttttcagaaccatatcataatatgcagtatctttgtcatgagaggtataatcaatcaccttgacaccctctctctcgtattgtgatacactgcgatctccagccggcgcaatctgaattacatcatccatcggataacctcccagtgactttctgcggttcttgtttaaaacttttgcgaagcggacttccccgtcaaaataagaatactcaaactccttggagtttcccatcagaacaaaccagacaattccgcataccagtgcaaccggtaatgtaatgccactggtcagacatgctgcaagcagactcactactgcaagtacaagcatcaatgtccccactacttttgcaaccacggtcttccggaccggtactaatacatatacttccaatcttctatctctccttcatttgtagtaatgttaattatactccatcccacactttttttccactaaagaatatttttttcataaatacagtagattttttgttccccagcccttacaataagagatattatttttcttttattttcggaggtgcatatgatacatattccaacagaaaaacttgcagattttgaaaaaaacatccgccgtgaatggaccatgaccaatggaatcggcggatacgcgggaggctccatcatcggtgcctgcaaccggacacatcagggatatctgattgccagtctgcatcccccggtcgagcgctatctggtattttccaaaaccaatgaaaaactgacacagggaacccatgtttacaatctggaaacttcccagcatgccgggaaaggacattctcccatccgcacgcaaggacagcgttttttaacggatttctcctgtgacggaactgtctgcttttcctattccgccggcaatatccgtatggacaaacatctggccctgctgcgggaatcaaacacagttgcgatctcctatacgattacaaaccagggagaggaagccggactttccatcaccccgcttatgaatttccgggagcacagtgcatcgtctgccgtttctgacctgcagtttacctgtgagccaaacacagtgggcggtttcactctgatcccggctgctgcacccggactctgcatcgagctttcctgcagtgccggcagactttttccacgtgaaaaccaatacgacgtggatatgcagtaccagacggaagtagacaacgaaacggcgggactggatacacatttttgcccatatgatctgcgttttacacttccggcacacagcagtacagagatttccctgctttgcaccgtccacccggtacaggacacccctgtgctttcccgcccgcaggcagataccgcagcaatcgaaatcgcacacgtacaggaatattatgattccttaaaacaacaggcgggatatggcgatgatgcttttgccaatacacttgtcgtggcagcagaccagtttcttgcccggcgcgattccaccggacttatgacaatccttgcaggtcttccgtggtttaccgactggggcagagataccatgatcgctttttccgggctgacactggccacccggcggttttcggatgcccgggaaattctttcgacctttgcgcagtatgtccatcacggcatggtcccgaatatgtttccggatgacgggcaggaccctctctataacactgcagatgcctctctgtggtatttttatgccgtggacgcatatttgaaggttaccggacaaccatcggattatgactatatacagcggcgtatttaccccgttctgtgtgaaattattcatgcctatgcacacggcacggatttttccatctatatggatgatgacgccctcatccatgccggaagcggattggaccaggtaacctggatggatgtccgtgtcggtgactgggtagctaccccgcgtcacggaaaaccggtagaaatcaatgcactgtggtacaatgcgctgtgcgtgactgcggaactggcagaacatttcaaagtagattcctccgtttaccgccagcttgccactcgtgtatctgcttctttccgaaaagaattctggaacgaaaaagacggatgtctctatgacgttattgaagaaaacggcaaagatgcaagcatccgccccaaccagatctatgccgtcagccttccacataccatgctcacggccaaacaggctctgcaggtggtaaataccgtagaggaaaagctgcttgccggtcccggcatacgctccctctctccggaacacaaagactatcacgggatctactgtggctctcttccgaaaagagatgccgcttaccatcagggaaccgcatggggatttctgatgggcggctttctgaccgcttacatgaaagtccaccaccactctccggaagcaaaaaaacaggcaatggcatatcttgcaccggtacagacccaccttttggaagagggctgcattggttctatttccgaaatttttgacggtgatgccccgcatacctgccgtggttgctatgcccaggcatggagcgttggagaaattctgcgctgctacacacaggatattcaaaaaaatcaaaaataatgatttttttcttgacaagaagatctcactcggatataataacaaatgttccgcgtgagattttcaattaagaaatccactgcaatgcctagttagctcagttggtagagcagaggactgaaaatcctcgtgtctctggttcgattccggaactaggcactatatgcgggtgtagttcaatggtagaacaccagccttccaagctggatacgtgggttcgattcccatcacccgctcttttaaagaaactgtttatccggtttctttttttatactcttttttatgaatatcctgtctcataccacgtaaaaaggacggctgcatctgcagtcgtcctttatatcatgtatgggtaataaaactcgcttagaagagatctacacttccaaagaacttgtcattgattacataatatgccttgtactcttccggctttacataaatatttaatgtcttaatgcatccggcacgatgtccctcagctacaaactgtttctttaccttatcctcaagttctccaagatttgcagcattctgctgatactgaacaatgatttcggtctttgccggctgtttttctttctttgcctttgtagcagcctttgctttcgttgcagctttcttcacaacaggttctgccttctcaacaacagcctttgttgttgcctttgcaacttcttttgccttctcttctacaacttctgctttctttgctgctgcctcagcaacatccccgacttttgattctactttttttgtagcatccttaaccgcatttttaacttctgtctttccctctggtgtcttcatcagcttcacgtcagaaactgctttgtttaacttcttctcctgcataacgattcctcctaaccagaattattcacatactaaaaatttttcaattgcatcaagtgctgcttcttcatcggcaccctccgtgacaatatcaaccgacattccatcggatggattaaacgccataattcccataatgctctttgcattaattctgcggttatcgctctccaacataatatcgctgtcgaactgacatgctacctgaacaagttctgcgattggattgtcgtgtccttctgacacattagaaacgatcacatttttcttactcatacgctctccctttccaaaactatataactcattctcaaatatatctcacttatccaggaattgcaatatacgaactttatttctgttaaatcttcacgaatcatccataaaaccttgtccttaattgttcatttttacaatgaaaattaacggtccaaataagtaaagaaaatgtatcctgctttccggaaccagtcatccgcatctttataactttttgacctcgtggaatgggtctgcggatcataataataaatgcttccagaggtatatcccgtcactaatacggcactgtctgttccggtcattgcaaataccgggctgcccttgctgacataaaacagaatctcctctactgtgcagctggatatatcaagaacaactgaatcttttaatgtattttcaatcgcgcttttcggggttcctccattgtcaatcagttcttttacactgagcccgtttcctctgtaattaagcatggcactgaccgcctgaaccacggatgatgaactcttatccgcatcgtttactttcaggctgctaaatgccgtctgtgccgatttacgcgcacgcatccatacatactgctgcttggaatccaccacaactcccatatgattattggcgcagacgatggcatccgcgatctcatcggttgcaagcagcacatcaccttttttgtacacataaaagtattcctgcgactccttatttttcacggaaacgtcacgcggattttccagtaaaacagatttggaagtcagcattttaattttggatgcatccgccccgtttttcatcataagctggtactgtgtttccttgcgatctgtcacggttgatcccacggtaactttttcttccgtgtctccctcacggttcatgatcgcatcggttcctgcagccacataatgtccgccggactttttgatcagatgaatggtaattgtataatcctccaccgaaatgaaaccgatacttcccctggacggttcatacgcctttaagatactgtgtgaattttcggaagtatccatgatggttaaatttttcatcgggaaaaccgtatttcccgctgctgcaaccatcaccttatctttctttgctgctccgtaaataaaatcttcatcgataaacccaagcggaagaatatactctcccttttttgccttgatatcatagacagaagcatttttcaaattcatcaggtgaatcacatcgcttttgtattctttgtcgctgtctacccacgcaaaatactgattcgattccgacactttataacagctttctttcagatctttcacaagcacttccggagtccgcttgtccgtatctatactgtaaagtttctgatccatgatcaggtaaaatgtccccttttcgttcacatacattaactgccccatctgtgctttgagtatttcataggaaacatccgacgggataaaaatttcttcctctatagtgtgtaccagaccatcataatgatatactgccgtgcccacttcgccttcatgatccccacggttcatatatccatatacaacaaaatcaatacttcccgcttcatccacacgggcaattttgatatcatgctgatcccagttatccctcgcattgatcccctctgccccaaggaaactgaatacctgtacaatcttattatttacacggtcaaagcaccagagttctccctgctgtacaaacgcgatcacatctccggtctcacttacagcatattcaatgtttttgtcacgtatgccaagttggatctgattattatctgtaataaaccggttttccccacgaaaaatctgatttaaagtacgctcaaaatttaagacatacatacgggattccgtcatacgcagacgataatattcttccacattataatactcggtttccccaccggttcctttggtggtcaccacataccggagtgtgatcacatcataggaatcattgatttccttgaaagatgcctcgagttctcccatctgctccggttttaaatctgcccaggtaatctggtttaaggtacagcttaaatccacataattgagtgtactggtatcgcctgttgccgcatccatatatttcggaataaatttatttgcatcatcccggaatgtatattcatgaaactgcagtgcaaaatccatacatgcctgggtatcatcgttttgtgtctgcatcagccgggtgtaataccggatcttattttttcctgaagcaagaataacaatcagttcatattcttccccttttccgagaatattctggattttcaggtttgcagagatttcattatttttttctttgatctcctgtgcatttccctttgcaaccagccgggaatcatcaagactccggatttcataagcaatgcctctgattttttgtccatatgtattaattttcagcggaagcagtcgtgtatggtctaccggcacaattccatcccgcatctttgtaatattcatttccgatacgtatccgtgcagctgtgccacgctgttatttccttcataaaactggacgatgggaagggttgcctccttcatcgccgttgtcatatctttattatcctgattggttatgatactgaaaacaatcagtgctgccagaaaaagccctgacagcaccactggtttaattactttcctgttcatttatcttttccttcttactatggctgtaatttctgccgttacatccatctcctgcatctgcgatgccggcagcgccgtttgcacatttccgcaccaaacagcacaccgatcatactgcaaagccacggattcccacattcccgttcctgtgttgtcatagtttctccggcgatagaagccggaaccattttgaaatatgatgccgcctgcatgtttccttcgatccggttctctttctttttctgcacttcggacagcttccggtaaattccatcaatttccatctgtatcatcaggcggtccggttcctcatcgtagatgcggcttccctcatattccagctggtcaagcctctgttccaccagctccatgatctcttttgtctctgccggatagtactgtttcattcgttccatatctttttcatattccatctctgtcaggtacatactctgcatcggatatgtcatataaaacggaatctttgggtaaaaatcgtttgaataatccacttgcatgctccatcctgtcatcattatagactatgccatgcaacggttttttgttcttattttcctactatttttaagcatatctgctcgtattccggataatttttgtgccgcatttccgtttccagtactccctgtgcattcttatggaaatgatataaattatacacacccttacggtaggcatagtcctctccattatcctgaaaatgatcgtaagaagcctctcccggagttgtcagcagatacagcgtacggtacggcttttctccaacatacgccattttttcatacatcgggatcatcgttccttctttcagatacatcgggcacaaatcaatcggtgcatcccgcaggaaatactttcctccggtaattttctctccggtccagtaatcataccactccccttccggcagatacaccattttcttcgtggctccctgctccaataccggggcaacgaggagattttctcctaccaggaactccccattgaggttataggtttccgggtcctttggataatgcagaaccagaggacgcataaccggaagtccggtctgttctccctgataaaacagatcatacagatacggaaggaaacgataacgcatctttacatattttcgatagattcccaccacctgatcatcaaactgccacggctcctgtctgcgtgttccctgacaggaatgatttcgaaacagcggagaaaatacggcagcctcgatccaccgggtcagaagttccggggtcgtatccgcaccgaatccgccaatgtcggttccggcaaacgcaaatccactcataccgagattacacagctgcggcaccatcatctgcagatgcgaccacagactctgattatctccggtccacacagtcgcatatttctgtgttcctgcatacgctgcacgtgtgataacaaacggacgcttatcggaaagtttctgcagtccctcaaaggtcgcacggctcatataatgtccatatacattgtgcatttccgcatgatttgtcgtacgctcctcatcatgaaatacaacatcctgcggcagctcgccacggaaacttgccggctcattcatatcattccatacaccgtccacaccgatgtcgaccagaaacttatggtgttttccccaccagtcgcgtactttgcggcgtccaaaatccggataatttgcatctcccggccaaacctcattgacataggtagttccctgtgtatcggtcgcaaaatatccgttctcttcgccttctttacacataaaatagtccggatcgactttggttcccggatcaatgatcgttaccgttttaaagccctgtttttttatttccgcaatcagatccccaggttttccgtactttgcatcattccatgtaaacacacgatacccatccatataatcaatgtcaaaatgaatggcatcacacggaatatccagatcacggaaatgttctgccacatcacggatatcttctgcgcactgatagccccagcggctctgctggtatccaagcgtccatcgctgcggcagcggtgtccgcccggtcagatatgtatattcttcaatcagatccgtcagtttttctccacccaggaagtacagatccagattgccatcatccgcgccgtaaaaataatattccggattttctttgcccagattgagatagctgtggaacgtattatcaaaaaacatgccatatacgtcattctttttcttgcagaagagcaccggaatcgacttgtacagcgcatgatagtcctcattgtgtgcctgtggaatatcggaattccagttctcatactcataattttttttattcaggaatccggtcttatcacccagaccgtaaaaatcatccccctcgtccagatcaaacatcatctgtaccggataatcatgtgcgcccagattcgacgtatcatgcccttccgactccagaatctgtttcatctgctcactgacttccccgcaaacacttctgacctgccggtgtgtccggacaagcggagtcccgtccggtctcgtaatcaccatttccagattttctccaaactgcatccggatcttatcggttgcaattaccagatcttctcctttttgctctgccgtcagttctgtcgcaaccgccttgtctccatcaatggccttagaataatgttcctttgttctgtaaggcacaaaaatattgacaatatcatcccttatggctttcaccaccagtttttgctgttcatacttcacacaaatctcatttccatcctgtcggaaggacataatttttcctgctgtactcattgtttcccctttccgttactctgtttcctgcgttgttgtatccggttcctgatcggtaacatagtctgaactgacatatcctttttgtccgttatattctgcctgcacccatccgttttcttctcccagcagtgtcagcttcgttcccgtcacgagaacggtaagaatttcactgtctgtattcggctctgcacggaaatttacgccatccgtgcttgtccatacactctgtccgtcttcgtccagcggctgttccgttaccggtggcagattgctgttgtctgccggcggtgcattatttgtgatttccgtttccggtgtctggtttttccctgcattccgcccatgaagccatacgataagtgatataattcctgcaagcagtgctgcgcagattatggcaaaaataattctggcaataatgacgtcttttctgtgacttgctttcatgatcgttgtccctccccttcatcttctgtacatataattgtggttttccctggatctaccttgtctttttccaaaatcagttttccaatcttatccgcccggatgattccgccggaaggattgagcacactgtccacggtatttacaatctgtgcatccaccgtggaatactcaaatgccagtgtcgtattaatcaatttacagttcaccattttcagattttctatataacacatgccctgcaggctctcaatcgtacagttgacaagtgtaagatttctggcattccatcccagatattctcccgaaataaaactgtcatacacagtaacatgattgctgttccagaatgcatctttggaaagcatgcgtgcatgatggatctccatgttttccacaccatcaaatgaataatttccaaccaattcaaaatgatccagctgcatatttttacaattcatggcaaaataatccccgtgtgcctgcacataggacaggtttacatcggtacagttccagagggtttcctctgcattcgggaaatttacatttgtcagggttactcccctgcaacggcggaaattttttggtgcttctacaatggaatctcttaccgaaatatcatcggtataccataccccggcccgcgccatgtcaaaccaggtacattcctttacatcgacatgtttgcaataccagagcggatatttccaccggaacagacaattatccagataaagactgctgctctccttcaacggggattccccatcctcaaacacactgtcatataccgccagattttcagactgaaacagtgcgcgttctcctgttaatttctgctgacgaagcacctgccgtgccgtgtcaaatttatcgttactcattttttattccttctttttcagcttgtaatgattaggtctgctagttattttaccacgagatcaccggaacattcaagtatgctactctaacaaaagctcctcgaccgtgacaaacgaatatccctgtttctgcaaggtatctatgaccgtaaatgccgcctgtacagatgacgccgaagcatcgtgaagcagaataatgtcccccggcttagtatcctttagaactctctgaaccacagtatccgcatcagtcgttgcccagtcccgcggatctacattccacagtacttcgatcagatttacctgcgcatccagttccttctgccagcatccgtaaggtggacggatatatcctacatattctcccgtcacatcataaatcgccttctgtgttttttcaatctgctgcaaagtgcatgccgtgcccacttccttaaaattaacatgtttataagaatgaacaccgatcagatgtccgtcatcatgcatccgtctgacgacatccggatactgttttacctcttctcccagcagaaaaaaagtggcttttacaccacgtttttctaatccgtccagcaatttcggtgtatattccggattcggcccgtcatcaaaggtaattgcaactgttttcatttctttctccactttctccggctgcagtgtcattgtacttacaacagccgctgcgtttccaatgctgtatgacaggaaaagaaacagtgcataccccacatatcttttccattgttttttgtctgccatttcataccacacaaatttcctgcttagtatatcgtatgaatttaatcataaaaaatatgttgtccttattctgaatcataagtttccctgctgatgccctccccgagcatcatccgttcctcatgctgcatttctttttcccggatggcgcgttcataaccggtcaatgctgcaaacggagaaaactgtgcggcccggtcttccgatggcatctgcggatgctttttcgaaaccggatgcggcagatctatgatgtcatcataacgatgcgtattttccagccggttcatgcccgatgtcctccaatctgtccgttgcgctgccgcatggttgccccttctttgaaattggttccttttaaaatggcatttttcccataacgctgcttaatggaaagcatggctttctgcatctgtttttccttctgcaatgcctgcttttgtgccttctgttcctcggtttcttccgcaaaatcaaacaggctcatctgctcataagtctgttctttttgtgcctcctgctctgtgcgtacatggcatgccgtaacatagatcctgcggatcaaaagatccggatttataattctgtcatataattccagtgttttttctactaccgtaatggcagaagatgtatgattttgcaaatttgccgtcccatgcgcatgctttggaatctttcttccgtaacgatccgtagtcacttccccgtgatatctttttgcccgcaccgggtctgtcagattttcgatatcatagccaaccgtcagcactatctgatccgtcacgaatccatgctccaccagatccagtaccagctggtctgtcatttcctgcacaacaatccttgctttatctgccgggtacggacactgcaatacctgtcccgatccggaactgttcgcctgcggacgatacgctttgatctgtgcaatcgtgcacggttcgtacccccaggcatgatcaatcaaaagttctgcattcacaccaaacagtttgtaaagcagatcttcattataataatctgtttcttttccgatggaacagcgcgccacatctcccatggtatatattccgttttctgccagtttcttcgcatatcccggtccgacacgccagaaatccgtgatcggccggtagtcccaaagcagtttacggtaacttttttcatccagctgggcaatgcgcacaccgttttcatccgcatcgatgtgctttgccacaatatccattgcgattttgcacagatacaggttggttccgatcccggcagtggccgtgatcccgatgtgatcctgcacatccagaatgatagtctgcgccagctgataagctgtcattccataggttttcagataatgtgtcacgtccataaacacttcatcaatcgaatatacatgaatatcttccggcgccacatatttcagatatatatcatagatccgcgtactgtattccacataaagtgccatccgcggaggtgccgcaatgtacgacaattccggctcaccggtttttcggctgcggtttacctgttttactttctgaaccacttcaaaaagcctggcccttcccggaatcccatattttttcagggatggagaaactgccaagcagatggttttttccgtgcggctttcatccgccaccaccagattggtggtcagcggatcaagtccacgctccacacattctacggatgcataaaatgatttcagatcaattgcgatatactgcggcatacctttcctctccccaaacagacattcgtgtatgctctcattatatcaaaatccgataagattgcaacgctatttacattccgtcacaaacacttcacatttctctaaaatcagcttattttcagcatttgttcgttttttatttgataaaagtaccttttttgccggaacttcccaatccagttctatggtatctgttccaaaatttgccgctaccagaacccggcgcccctgcaggatgcggtaatatgccattacgtgatctgcattctcatatgccggctcaaattttccataagtaaacaactcccgatattccccagatttgcgcaatgcgataagttttctgtaataatgcagaaccgaatccagctgcccttcctctttttccacattgatcaccggataattatcattgactttcagccatggagttcccgaggtaaagcccgcctgcggcgcatccttccactgcatcggcgtccgtgcattgtccctgctcatgaccgaacatacggcaagtgcttctgcatccgaaagtccggcctcacgcgccaccctgtactggtctttggtactgatatcatcgaattcatccacactgttgaatctggcattctgcatgccaatctcctgcccctgataaataaacggaattccacgcagcagaacacttactgtaccaagcatctttgccccgtccgcattttgcgcatcatccggcagaaaacgggaaacgccgcgcggctcatcgtgattttcaatgatatttgcctcgaacccgacattctgtacccgcatctgggaatctgtgattgcttttttccacgcatcaaaagaaattggtggcgcatcgtaccatccgtgtttcccgtcactgagcatatgggcgctgaaatcaaaaattgtagaaaaatgtccattttctccaataaagtccggcaggtcttccaccccaatgttaaatacttcccctaccgtaaatgcatcctttttggcaaatgtatgattctttaaatcttcaagcagcgcatcgacaccttctacattttcgaccatacgccaacagcttgccagtccatcgtcaccatccggctccatatccggaaatgccagatcttttttaatattgatgatcgcatcaatccgaaaacctgccagtcctttgtccagccaccagttgatcatccggtagatttcttccctcagttttgggttttcccagtttaaatccggctgctcctttgcgaacatatggaaataatatttgtccgatcccggtaccggctcccagcagtttcccccgaaataagaacggtaattgctcggtggatttccattctttcccttccggaaataaaaataatcggcatacggtccgtccggatccgccagtgctttctgaaaccattcatgcttgtcggagcagtgattgacaaccagatccataatcagatacatatctctctttttggcctccgcaagcagttcgtcgaattcctccatcgttccgaattcttcagcgattgcataatagtccgaaatatcatagccctgatccacaaatggggacttatagattggagaaagccagataatgtcaactcccagctcctttaaatagtccagtttggaaataatgccccgcaggtcaccgatcccatctccgtttgtatcgcaaaaactctttggataaatctgatatgccaccttgtcatgccaccattttttctgcatgtccatgtcctccttcacctgtatctccatgtcctttgacaatttgtttctgtaacattatactgtcattatagtttggaattttaaaattatcttgcataattcttactttttataacacaatactgctctcataagacaaaggagaattttccatgaaacggttacagacacttgcccttgaacagaaagaagatgcccgtcacggtgacgcgaccttccccatacagaaatatatcacttctttaaagccggattatccggtcataacaacgcactggcacgaagaggctgaatttacactcatcaccgaaggagatgccagctaccagatcgaccttacttcctacgctgtggaaaaagacgatctgatttttatcccgcctctgctgctgcactcggtctcccgcggacagtctgcgctttaccagtccgaaacctatgtgtttcacatgaactttctcggtggaaatgcgaccgatatctgctccacccgttatctgatgccactgaccaatgaagaactgtcggttccctgtctgatccgtccaacccatccggcttatgtatctctgcgcaaaatttttgcacagatcagttctctctttgcaaatccggttgagggatacgaactggccattaaggcattactgctgcaggttattttcctgctcctgcagaaccgtaccccggacgggaaacgatctgtcgacaccgcaaacgcctctgaaaaattaaaaaccgtactggactatatccatctgcactatgccgagccgcttacggttgccggtctcgctgcccaatgctatttcagcgaatattactttatgcgttttttcaaaaaacacatgaacatgaccgtagtggaatacctcaacaatcttcgattggaaaaggctgtagaactgtttgaacagggaaacacctccattttggaagtctctctcgccacaggattccacaacctttcctattttcataaagtttttaaacggaaattccacatgacgcccagagaatttctaaaaaaactatcgtctttttaaaagcccgtcacaaaaagcccgatatttaatgctgtaactacaattgcaattgcccagagaaccattttaagtccggtactgtttgcatactttcccatcacttttttggacgaggtaagataaatctgcgtaaaaatagtgatcggaagctgtactgcaagaagcatctgggaataaatcaatccctgaaacggagaccggatcagcagaatgataagcgctgccggaatcatcgtaatcaaaacaccctgtctggtttctttcgtcgcaatatcataaggtttattaaaaattccggaaaaagtcgttcctcccgccatccctgcggtaatacttgaagaaagcccggcaagtaaaagggcaatggcaaaaatcaccgttgcttcatttccaagcagtggtgtcagcatatttcccgcagtcgtcagatcatccacctggttttcccctctctgataaaacgtcgccgccgccatgagaatcatggcgctgttaatcgcccatccgatgatcatggaaaacagcgtatccttaaattcaaatttcaattgtctctgaatcaccgcttcttctttcagattccacttccggctctgaatgatctccgaatgtaaaaacagattgtgcggcatgacaaccgcgccaagcacgctcatgataaccggcatcgcatgcgatggaaataccggttttacccatcctgtggcggcagctccccagtcaattttcaccatacagatttcaattaaaaagcaaaaaccaatcagagagacaaaaagcatgatcagtttttcgatccttttatatgcattggtaaattcacagaacaagaccacgacaaggatcagcatgctgcccactttaaccggaatgtggaacagcatctgcagtgcaatggcacctcctaaaatctctgccatcgcagtcgcaatggcagcggctactgccgttacaagaatcacattcttcaatgtcctgtttatgtaacggcttgctgcctcggacagacacaatcccgtcacaatccccagatgtgctgcattgtgctgtaaaataatcagcataatcgttgaaagagttaccatccagagcagggtatatccatatcccgatccggctgcaatattggatgcccagtttcccggatcaataaacccgactgttaccagcagtccggggccgataaacttcaaaatatttaaattgtcttttttttctttcctgttatttttattcatacatcagaaatcctttcttttcatactattcacacagttagttttaactaactgcataatacacaaacattgaacttgtgtcaatgaaacggcattttattcccgtttttttatgcataattattattgacatgcgcaccaatatatcatagtatttatttatgttagatatagttttcaatactacattagttagtttttatttacacattgtaagaaaggagattttaccatgcaattaacaattcgggaacccggaagcgccatcacacattttatcggttgcctgatggctttgatcgcagcctcaccacttttaataaaagcccatggaaatacaacctatatgcttgccatgaccatttttgccacaagcatggttttattgtacgcagcaagcacaatctatcacagtatctgtcatgtatctgctaaggtactccggaattttcagaagcttgatcatatgatgatcttcgttctgattgccggatcttatacccctgtctgcatgatcatcttaggcggcagaattggatatacccttctggctcttgtatggggaattgcagtggcaggaatcattatcaaaggactctggatcacctgtccgaaatggttttcttccatcatttacattgccatgggctggacgtgcctgccagtatttacccagctgtggacggatctcccgcatgccgcatttggctggcttttagcgggcggcatcatctacaccatcggtggtgtaatctatgctctgaaacttccggtatttaacgcacttcacaaatacttcggcagccatgaaattttccatctgttcgtgatgggtggaagtgtctgtcactttatctttatgtatcattatgtaatatgatcatttattttctgtcacggttcgtaggtctccctgcgaaccgtaactatttttccacttttgtgatctgctctgtggtgcagtcataaacatattctattaccggatcttcttcggaaccggacattttctctgaacttactgcaaatattatcttctttgcagtaaattcttccggaataatatagccattttcgtcatcaacattctgtgtgaataacagtttattattctttccgttccggtcacagcgatacacattcatcttattcatgtgtgttccaccttccggataggtcgcataataaactttattcgttccgttcgaccagctcatacggtaatcttttgataaggttccctgatactctgctgccgcctggactgctgttcctgaaagaacaaaacagaaaacaaaaacggcacaaattgttgtaattaatcgtttcatttttcgtttcctcctgcttcttttttgctacccctgttttaccatggtatgctttcggtttcaaatggattaagaaaaatgtaagaattttccatattttcacaaaaaacggttgatgcctgcataaagctgttcaaatttcatatactgtttctaacaattataaaaccgtgaggaatctatgtctttaaaaaccaatctgttccgttttatttttatttctgtactgggtgttcttctccatttcacctatgaatggtccggagataacgctgtcgtcgggttattctcagctgtaaatgagtccacctgggagcatttaaaacttttgtttttcccgtttctgcttctgaccatcctcgaagtgctgctccgcggcaatatgcttccagaacagtttctcccggcaagagttctcggtatcctcgccggaatgggcgggattgtggtcggattttatacgctgcggggtgtgcttggccgaaactacgatgctttaaatatcgctttgtattttgcaggggttcttctgtcattgtttgtcgaaaacaaacgatatcgcaagtcttctcttctgtcgacgaaagccgcagccgctgtcctgctgttgcttacggttgcatttttcgtgttcacctattgcccgccggatattggattgttttgggatcctacagtcggcctttgatggtgtagtgctaccacagtctcatctgtactttcgttgtcccgatccacacccaatacatttctgccattcatatatatcggaaatttaaaccggagaccttttaatattctgccatccttttgctcttcctcatagataaatacatcggacagaaagctcttcaaaaatgtcttcttttccagatctgtaaatttatcatacagcttatcaaagaataaaaggaactggtaaacattatcttctgagattttgtcctgcctgatattataaagtcttgtttcgacttcttctatggcattctcaatatcggtgatttcatcatacagcttatcaagtcgttcctgcatgtcattgtactatccgttattcttcttgcatcaagcattaccgcagcctgccagataagcatgttacaattcggatattcctttataagcctcaatgcccattcgtaagtcttctcgtagccttcttctaaaaacattctgtccatcttcctgataatttcttcgatttcagtatctgaaagttttttaatttgatccatctgttttccccctctctgatttgattatcccataggcgtttgcaaaacgccacagaccgcataaatacggcattttttgttaccaaattaaaataactcctcaccggatatggtataatagagttgactaaaaactacaaaccatgtacccaagaaaggagttattctgatacatatgataccatataaacagctttctttggcagatatttttcaagattgccaaaataaatttaataatgacaagcctgcatttctttctctattagaaacccatatcgatattgatgagtttattccgatttcttttagaaatcatttctatgcatcaacgggaagatcccgtaaataccctttacgtgctttcctgtgggctttgattatccagcgtatcttctcaatccctacagaccagcttcttttaacttttctggtttactcgaaacctcttcgtgatttctgcggttttaccaaagtccctgatgcctctaagattacacgcttcaaacaggactttttagatgatctgcagcttgtttttgataaacttgttgatatcaccgaaccaatctgtcaggctgttgattccgcaaaagccgatatgaccatctttgattcttctggcattgaagcttttgttactgagaataatcccaagtatgctaaccgcattatcagacagcttaaggcttatgcaaaagctaacagcttcgacaagaattatgatccttataaagccgcttatggttctatgccttcgcacgcgtctgctaatcctgaaattaaacagttatacatcaatgggcatttctgttatgtcttcaaatttggcatcattaccaacggtcttggaatcatcaggcatatcgctttttataacaaaaactttatagcttcccatcctgacattaccgttgaaaagaaatctgattcacctgatgaagacaagtctgtccatgattccaggcttttaattccaaccctgaaagatttctttttaaagcatccattgattaatcccaaaacttttcttggcgatgctgcttttgatactgcggcactctatcccaaacttcttaccggtaatacgttcggagatcataaacactttgataaagcttatatcccactgaattccagggctggtcttgaaaaacaggactacacgattaatgaaaatgggattccctgctgtcctcatgatgattcacttcccatgaaatatgaaggaatatcaaaactcagaagcggtgttaccagatataagtttgtctgtcctaaaattaagtggatcaaaaatgcatctactggcagatcccagcgtcactgtacatgtgatgatccatgtacagcttcttcttgtggcagaatggtgtatatttatcctgaaaaggatctccgtgcctatcctggcgctatccgtggtacagaagaatggaataacacttacaaaatcagaaccaccgtagaaagagatattaaccacatcaaggataatctttgtctggccggaagaagaactcagaatgagaaaacacttcacgccgatctgatccttgcaggaattacccaactaataacagttgtactttcggataaaatcaatcatcacgaatttattcgcagcttaaaacctcttattgcttaggacttaccaactcaataaagtctacggcttatttaagtgcgcctaaaacagctcaatatccgttttcgtcattaaaatcatgctatgctcaattctgtttctattttgattcaagtttgcgaacgagcatcgcgagtttcgcaattacctattgattatcccatgatttgattcccaatcacacccacgcaacgtagaatatggtgaattttacggtttctatgctacgtagagtgaaatttgaagtcacagaatcatttcccataacaaagatgaaataaatggttgaaggaagaacataataagtactacagatgcacatattatgtaaaagtcgttcttttttgaatttttcactatttttcttgtaaaaatacctgtaaaccaatatgcaattagatacccgactaaagtacctgcaatgtttgtaataatgtcatctatatctgtcgctcgtcctgtgaaaatttgagctatttcgataaatgatgtcattgcaaatcctgctataaatactttttttgcattcctgaattctttccataacactggcaaaaagaagccaaaaggaacaaacaataacacattcaagcacgcattactaaaatcatttatcatatatataaaaggaattatctgatgctaccggcattcccatttcaacgcttggcaaatgagacttatataaatggtcttttgcttcttttctgtaaaaatctggagatgaaagtcactcagctttctgtagaagaaaagtaaacattaagagaaagagactctttattactgttgtagtcaagtaaatagttttttacagtgcttttcgctgtctctagccaagctgtctggccggaaattctgctgctgcactcaccagcttttcgacaatctcaagcttatcgccttgttcagcgtaagcacaaagtataacggctgccgctattatctcatccctgtctgccacacataccgtggcaccagttacctttgacaggctctgtgcatatgcctgtgatatatttttgaggcttcccacctgcgaatatttctttagcactatcgtctcgtctgcatccatatatatttccagcgggctgccctccttgatatggagcatcctgcgcagttccttcggtatgactattctgccgagtgagtctactcttctggtcaatcctgtaattttcactttattgtcctccgttacttttgcatttgcattcatgctttggaggtagtatatggaaatctgtatgaaatatgtataattcaagggggaaaagacatcatctatgcatgcttgcatgcaattcgatgtatgtcttattgacccgcactacactgagaaagtagcaatttactgcttaaaggcagtaaattagcggattaaatatgtatctatatccatcagctctctctcatctgcaatatctacatatacacagtcatgcttctttgccacacttctgccacccttatcaccctccagtgataaaagctgtggtataagcgatgaattaaatacacacgggttgcctacagcatctccacaacgaagtgaaaacgccaatcgcttaccccctgtatttttaagcactctgtctattaatttaatcacgctttgactttttaaatatggctggtcagctactgcaaacatgtaatattcctctttttcggcagtatgatgcgtcacttcactgcttttcttaagctttttctgctcctgcaccgccataattcctgcctttatagtgtaggatatgcctttttcgctgtccggacttatgactgcatggcaatctgggatacatgcgcagtagtccaatatttcccggtaacgggtgacaactgttatatctatggtctggctgtctgattttgatttattatatctatttttaatttccgccaagcgatcaagcaaatgcctgtacataggttttccatccagctcataaaacagtttgttacttccaaaacggcggctgtttccagccgccatgtatatgatatgaatcatttcactctaaggtccttttcgtgccagtttgggtctaccattcccataagtattttttcaggggtaaacggaactgtcctgtgccatacgcctgttgcgcgataaatggcatgtgccagcgcaggagccggtgtattgataactatctcaccgattgacttaactccgaatgggcctgacggctcatagcttgtctcaaattcgacattgatattgcccacatcctgtcgtgtcggtatcttgtactgcatgaggtcattttctgcgatttttccatcggcattgtaggtgacattctcataaagcgccatgcctattccctgacctatgccgccctcggtctgtacacgcgcgaggtttggattgaccggaattccgcagtccacaacagcctgataatcaagtattttaactgctcctgtctccttatcaagctctatctcgaccattcctaccatgtatggaggaggtgaaacaggtgatgaatatgtcgctgtgacatctacaggtatcgtgttgttgacctgtgattttgttgctatatcggaaagacttacgcaaacctccccattgtctgcaccgtccggatttatgatatacacccctttgccgtcaaaatccacctctgatgcagcatggcccagcatctgtgcaccgattttctttatgttttcacgaagctcaagtgctgcattctgtgtggccattcctgtaatgtaggtggttgatgaggcatatgaacctgaatcataaggagaagcatccgtatccgctccaaacacggttatatcatccggctcgcagtcgagtacctcagccgccatctgcgcaagtatggtatcacagcctgttcccatgtctgccgcgcctatcatcatattgtaggtgccacagtctgaaagctttaaggtacacgatccgacatctacatttgatatgcaggagccctgcattgcaagtgccatgcctgccgcacgaaccttgccatttcccatatcgcggacaggatacttgtctgcccaatggaaattatccgcacagtgcattatgcatctgtcgagtgcacatgcattggctgtctcgccaaaatatgccggcataaacatgccctcacggacgatatttttcaaacgaagctcaaccgggtctatatgcagcttttcagcgagctcattgacagttgattcaagtgcaaagataccctgtgtagctccatagcctctatatgctcctgccgcctgcacgtttgtgtacacaacatcgcacgaaaatctggttgcctcgcagcctcctgtataaagagggagtgatttatgacctgagagtcctactgttgtagtgctatgctctccgtatgctccaccatttgacagcgtataaagatctatcgcccttatatgaccatccctcattgctccaagacgcacggtaacctccatctcatgacgcggtgacgcgatagtctggcactcttttctgctgtagattatcttgctcggacgctttgtcttccaggtaacaaatgccggatatacctcacagaccgctgtctgcttggcaccaaagcctcctccgatacgcggcttttcagcacgcaccatggacttaggaatatcgagtgcattggacagtattcggcgcaggtggaaaacaatctgtgtcgagctgatgcagtgaagcctgccgtatctgtctatctcacagtatgctctgcaggtctccatatatgcctgctgcgctgcctttatgcgataggtgtgctcaataatctcatcgcactccgacagaattttctctacatttccatgctcatcctcctcatgatgaatgagattgcgctttacatcgcctgtatttatgctggatgaccagtcatcctcaggatgcacaagcaccttgttgtccagcgactttctgaagtcaagcaccggctcaagaatcgtgtactttacttttatcatgttaagagccttgtctacagccttttccgattcacctaccacaatagcgacagcgtcacctacacttctaacatgacggtcaaggattagtctgtcgtacggtgacggctccggaaaggtctggcctgcgatagaaaaacgctttttcggaacatcctcccaggtgtatactgcgaccatgcccggtaccttaagagcaatatctgtctttacatcctcgacaattgcattcgcataggggcttctaagaagctttatgacaagcgcatcacgcggtgtgatatcatcagtaaataccggctttccgagtaaaagctggctcgaatccttcttcggtatacattttccaactgcgtggtaatcccttctcgcgcggttgaagctgtttacattagtttgatttgtgctcatcctgccactcctttccgatatcctctccgtagacgcctgcctcgagattaagaggtgcgccctccttcttactgtttaagaaatttctgattgagcggagctgactctgatatcctgtacaacgacacagatttcctgaaagatactcaagaacttcctcatcagtcgggtcaggattttctcttaaaagtgccacaatatttacaatataacctggattacagaagccgcactgatccgctccctgtgcagcaaaaaatcctgtaaactgcttagcttcctcctcaagtccctcaagggtatccacggctctgccgtctgccctgcctatcggcatgctgcatgacagcacaggctttccatccagaagcactgtacaaagaccgcagttgcctgactcacagcccctcttcactgaaaagcagttgtgcttgcggcagaagtccaaaagcaccatatcctggtcaaccgagtcaattattaactttccatttaattttattttaacatccatatacatgaattccttcctacttaatgctcgtgcattgatgtcatcacactaataaagctcccaaagtttcctgcataacttccatgcatccggtagcgattaccttatatcatcgcagatgtcaagcgactgtgtgacagcgcggcgtgtaagcacccggcagatcatctctctgtactcggctcctgctctgatattgcttccaaaacggatatgctctgcaacatattctgcaaatttatctatttttgcattgttctcggagttctccgtcaaagctacattaccgtgcgtctttgcatctactataccatcgagtatgccgtccttatcccacacaggctctgccatatatggtgatgctccgatgaccgccacatacctgccgtttctatttgccactgcacatgtgagcacaggaaagtctgttgactggtttctctggcttaagtatactacgccctttgcatttttcggcactattactgatacgagcacatcgcgcgtggttcttggaagtgccgcaaactcgtccaaatccataattcctgccttgtgaagctgcacctttgctcccagcgccctgaaaatcgtcatgacatctgaaaatccaaatctgccccagatgcttcctccgacagtcgccacatttctaaactgcactccgacgatatgtctgaccgactctgcgattgcaccgtgtgtatatgcattcagggtttcatgtgtctctatctgcctgagggttgcatatgcaccgattctaaactcgttttcatcctcatcaatccggtcaagtccgagatcgcacaaatcaattgccgtgccaagtgtcttatttttcattttgagccagagcatgccgcccagcacaaaattcggttttttctgataaagctcataggcttcatcaaggctttgcgccctcacatactgattgtaataaaacatatttttctcctatatcaatacatttcaagctcatacatggcttcccacctaatgtcctgctccttcataaaggctatgaggctctccctgtctgaaagctctgcacgccatgccagaccacagcccgccgatatagcagacggaagaggaatcgtgcgccccggaataccacatgccttgcccttgatatccagctttaacggcgctgtggtagtctcgaaggtaatgattagccgctttttcttttctcttaccaaattattatccatcacatcacacttaatataacactaaggactcacaataagagaggctgcagccattttctcggcgatatcatacatgttcgtcacctctccgactgcaagcttatctgacagctcatagtaattcagacatgttccgcaggtaaagattttcacgccacgattcttaagctcctttaaatcctcaaggcactctgagccatcacaggtcagctttgctcctccattgtagaaaagcatggtttcaggcggattgtcctgctgcgaaagtgcatagatgaagccctttatgagtacactgcccagctcctcgctgccctctcccatataggaagagcggattacaacgactctgttatctgtagccggcctgcatgtgtactgtgaagcttcgtctgtatccgaaaacgctcctgtgttaagagtctcaattgtcagctttacactgtagcttccgtcgtcgagcttattgctgtcgcagctatagcccttctgtgcagccatcttttttaaattttctactgcaatttcattgtccacaagtgtctccactgtgtccggctgtgtgagagcctcaattgccttctttgtctttactaccgggattggacatgtatccccgattgcatttactgtaatcatatttataatcctccctatgttatttaacttgtcaaccctcaaaatgcagggcatgcagcctgtcagcatatttacataagctatgatcgcttaaaatcagttcacatatatcggcacatcgcagcgcttaacaaatcgtcccacctttgcagccggaagccctgcggctttaagctcatgcaaaaaggtatctgcctcaaaggcttttactgcaaacagcagtcctcctgaggtctgcggatcgaagagcacctcctccattgagaaaggtatattttttgcaaaacgcaccttgtcacctacatggtttctgttgcgctgcgccgctgccgtgaggaaaaactcatctgcgcatcgcagtgctccggtaatgaccgggatggaaatcgagtcgataagtgctgttatatcatcatttaacatctcgctcagatgtcctaaaaaactaaagcccgtgacatctgtgcatgcatgtatttcgaagctgtgactgatctctgatgccgcgcggtttagtgtggtcatggagcttaccgcatcctcaattgcacctaacggagcttccccgacacggtttgcgttgcacacaagcccaactccgagcttcttggtcagtataagcacatctgacggctgccctgtattgttgctgtagatgtgtttgggatgaactgtgcccatgacagaaagtccgtatttcacatcgctgtctgctatggaatgaccacctgcaagtgtaccgcctgcctctatcaccttgtcagcgcctccctgcattattttaccgagtatattcaaatccattttctcagggaaacaaacgatgttcaacgcactcttaactgtgccacccatcgcatagatatcactgagcgcatttgcggccgctatctgtccaaacgtatatggatcatcaaccatcggtggaaaaaaatcaagcgtctggactatcgccgtgtcatctgaaattctgtacactgccgcatcatcgctgctatcatatccgacgagcagattgctgtctttttcgctctttggcaactttgctaaaacatgacttaataaatccggaccaagctttgcagtacagccaccgcctttgcaaaacactatttcctgtggcatgtttgctcctttcaattgtttaatactgtttatctcaatgccgcaatctgcataagcgcttcagcggcctcatttatctcatcatttgtattataatatgaaaatgaaaatctcaccataccctgtttttgtgttccaaagaatttatgcatcagtggtgcgcagtgtatgccgcttcttgttgcaatgccatactcatttataagtatatccgacacctccgcagaatccatatcagctatatttactgaaacaatcgcacaatgtgctccattatcgggcagcatgtcgaaatccccatatatcctgattcccgggattatctttattttctttagaaaagccttcatcaacatatactctttagcatatatgttatccacaccaatttcttcaatcgcctttattcctgccaaaagccctgcaattcccgggccatttaaggtaccggcctcaagtcttgtcggaagctccataggctggctctcaagaaagctgagcacgccggtgccaccgcttttaaccggctttatatctgctctttctcccacataaagtcctccggttccctgtggacccatcagccccttgtgccctgtgaagcagagcacatcaatattcatgtcttttacatttatcggaagcacaccggctgtctgcgatgcgtcaactataaataaaaggtcatgctttcgtgcgatttgccctattgacttaatgtccaccacattgcctgtgagatttgaagcatgtgtgcagacgatggcttttgtttccggacaaattgcagcctctatatcccgcggggaaattatccctctttttattccttcatcactgcatggcacaatatccacgcacactcccctctccctttgcatataaagaggtctgagcaccgaattgtgctcgagctgtgtcgtaatcacattctcccccggctcaagcagtccgtggattgcaatgttgagcgactcagtggaatttgccgtaaaaacaagtctatccgcatcctccccgccgaaaaattctgtaaggcacattctggcctcatatattttccttgacgcatcaagcgatgcatccgacattccccgacctgaattgccgcagtgcttcattgcatcaagcacagcatcatataccgcatccggctttttaattgttgtggcagcgttgtccaggtaaatcatagtatgtcctcatttacttctcatccaagcagataaaatttctttatataaagctcatcatttatatttttgctaagcatatttgcttctgtatgctttggaagatttgcataaattgttgaatcattatttaattcacacgatacttcccatgtttttagttcttcaactattttataatctttaatcctgattatatttttattgttatatgcaagtaccgattttgctttacttgcagatattattatatcctgagggaaaacacctatgtgtgatatgttgtccgtatccatcgcaagctgttcaatctgctcatcagtgacctcaaatacgctatcccattccacggcaagaacatgatgcttatcctgccatttcacctgtgatatattgttgcagcccacaagcagtgcctgctccacagacataggccgcatgaagaaatcttttttgtcgcggactgcactcagcatgccgctctcaatacttccgatacgctctgccagacgatacacctcatcgcgattgtgtgacacaaagataacaggattgtgaaaatcggaaagcatctccataagctctgattccatacttcttttcacatgctcatccagtgccgaaaaaggctcatcgagcagtatacactccggtttagccgcaagcatgcgaagcattgccacgcgctgcctctggcctcccgagagatgatccggatatgtgtctgccatgccatcaagcccataccgcttcagccagaccttcacctttttttcatcgcgatgtcccattgctatgcatatattttccatcacggtcattgtaggaaaaagtgcatagtcctgaaacagatagcctaccctgcgcttaccggggtgcagatttatgcgattttttgagtcatacagcacccggtcatttaatgatataaagcctgaatcaggagtctctatccctgctatacacttgagtgtcatactctttcctgagcccgacataccaattacggacacaatctcgtccgtaagctccatgtcaaccgaaagcatgaaattatccaactgtttttttatttttactatgagcgacattattttttctctttctctttatgcccttgcttttgccgcatatcatatttatcgatacaaggcatgcaaacgaaatcgctatgattactatgcaccagaagcccgctgtggcatagtcaccactttggatgaccattgctatctgctgtgatatggtcgatgtctttcccgctatatttccggcaagcattgatgtggcgccgtactcaccgatagctctggcaaaggccagtgtgacacccgatatgatgccgggctttgccatcggcaaacgtattttccagaaaaccttccactcacttatgccgagagtgcgcgccgcatatatgacattttcgtctatctgctcaaatgccgctctcgcatttctgtacatgagagggagtgcaatgatggtcgctgcaaccacacagccaagccacgtgtgtactacctgtatacccatgctattgcttaaaaaacttccaaagggacgtcttgtactgaaaatccttaaaaggatgtatccagccacggtaggcggcaataccatcggaagtgtcagcagtccatcccagaatgccctcactctgccctttgtgtttataacaagctcagcaaaggctattccaataaagaatgaaaaaaccgacgctactattcctgtttttaatgttatccaaagcggtgcgaaatcaatcgttcccattattcatttaccgtaaaatgatatttctcaaatactgacattgcctcatctgtctgaagatatgcaataaattcctttgcggcttcaagctcgtctgctgtagtgttgtcaccctttaaggctgctatcggatatataacatcacctgttaagctgtttggaagcttttctataatgtcaagctgattctcgtatccgaatgtatctgagtaataaactgttcctatttcgtttgcaccctcagctacggcagatgcaactgcacctacatttgcacagctgttgatttccagaccgccaagtgcctttgagatatcagaatctgaaatatcctgtggctttgaagcatctccttcaaccatttttgaatttacaagtgctactctggtgtactgtcctacaggaactgttccgtcagcaagtgccatatttttagcctttgagatgtctgcaaagctggtaactgccgtgccactattcttatatgtaacaaggcacacctgattatttaaaaggtcaacacgagtatcatcaaccacgcttcctgcttcataaccattctgaagctcatccatctgtgccactcctgctgagaaaaagatattgcacttcgcgccctctttaatctgtgccatcagagttcccgaactgtcatagttgttctggaagtttacatttggatgctccttggtgtaggctgcacaaatttcatccataacactgtttaagctctttgccgcaaaaatcgataaatctacatctacattaccgttctctgtctgcgcgctgcttgtcacaattttatcagtagcattaccgctctctgcagtatccttctttccgcagcctgcaaaaagtcctgctgtaagaataagtccaagcgtaagtcctgcatatgctgcaaattttctctttaaacccttgcgctcctttactgatttatcagtgcctgttgctcttcttaaaatcacacttttaatctctcttttctttttatttattcatcatttgatctgctccagcagcactgaaatgctacctccgcacaccattccctcattctcggcatcgtcagtattcatgctgacatcaatcagctcacatttgaactcctgattgcgaaacagcctcctgcagcggcttataactaaagcctccgcacagcctccgcctattgttccaacaatacggttgtctgagctcacaagcatctgtgtgccaactccgcgcggtgcactgccgttcttttttatgatggtacacagtatgtacttctcatccggggagtgtgtaactgatgcacaatgcccagccacctcagtaagtgcgtcaagcacttcgttatctatctgagtgcagcttgtacactcatttttacactttactatctcgcttatcaccgaaagagcaatttcctccggtgtctgtccacctattgcaaggcctatcggagaatgtaatcctgatataatttcctgtgaaaatcccgattcttcaaggtcttttttcactatcacagctcttttctttgagcccatcatacccacataggcataggactttgtgaatatctctgtgaggcattccatatcgaagcgatgtcctcttgtcatgcatacatagtaatcatccgcctgcggctgtagcttggcgagagtttctttataatcgccgcaaatcacatggtctgcgccttggcgctttgcattgtctgcaaacaaaggtctgtcctctatcacccatatgtcaaatgccaaaagcgatgccatgcgtacaagtgccgccgatacatgccctccaccgcagattatgagacgtggtctgctgcctatctgctgtctgaacatcacaatggaattatcattgtcatctatttcatctgcccacacattgccgtatgccactcttattctgccatctatatagagtgcctttgccccggcatgtgctccttctatgactgtcaaaagctcacagcggctgtccacaggtctgtcctttatcgaagcatatatgttggccggaatcaacttcacctcgtcaccggcatgaatctgaccacctcttacgactaccgcaaacacaccctcctttggcataatgcactcgcccatcctcttgtatatggcacaatgcgaatggcactgcttgcctatctgcgtcatctcaaggatggtatctcctatgcaaaagcgtgtaccaagaggcagatttcctaaatcaaatcctgaaataattaaattttcaccgaatgcaccgttgtctatctgtgcccctcttgccctgaagtcatctattttctccgcggaaagcaggctgacctgcctgtgccactttccggcatgtgcatctcccatgatgccgtagtctgcgacaagctccgcctgtggcacctctctcttttcagttcctctctctttgcttatattgattgcaagaagctttcccattattttctatcagccccctatccggctcatatttcttgctgcatttacttccgcagcttctatctctgtagtctttgtctctgtagtttttgtatatgtcactgcattatcattaaaattgtgacaccttggctttgcctttatggcagcccttagtgcccggactattgcaaaatctttttccacatcatctgcaaaatcccatgaatcaggtactaaatccattgtcacgctgcttcccaggcatggcataagcctgccgtcagccgtaacacgtatgcggttgcaggtgtcgcagaacttcccatgaattgcctgaatcagacctactctgataccaagttccggaaaaatgtaatactctgccgggccgttatccggaattttccgtttgtcatttcccgaattaatttcttttgttttttcagtatttatacggcaaggttctccatacagttttgaaagtgtaccaataaccttcttatatggctcgactccgttggtgtgtccttcacctaccggcatcatctctataaagcggatatctgtacctttttttgcaacatatcgtgtgagcgccaccacatctgtctgcggtgtgagcaccacattgattttcactcttattccgcactctatagcggcattgattccatgctttacttcttcaagcagcggtttttttgtgatgcgttcatattctgacgcatctatagtgtccaggctcacatttatgctgtctatgcctgcttcctttaaccactttgcatgctgcgcaagcagtactgcatttgtagtaagcgatacgctgctgacacccggtatctttttgatttgtaaaaccatttcatcaagctgcggatgcaaaagcggctcaccgcctgtcagacgaaaatgcttaattccaagccttgtggctgcgcggactatgcaaagcacctcttttacgctaagtatatttagtgcatgacagtgctcattattgtcacagggattgcagtaatagcagtttaaattacagctatctatcaccgatatgcgcatatagtcaatctctctgccaaatccatcgcgcatgttaaaagccctttccaaaaccacagttaggaaacgtgcagacatcacaattcaggcagaggccgccttctccaagtccggcaagctcatctgcataaatcatatcacgtgccataagcctaggcaacacaatatcaaatatcgtgcgcttattgtacatggcacagccgggcagcccacatatcggcaccagcctgtcacctgcatcatagtacgacagcaaaaacatggctcccggaagcaccggcgagccgtatgacacaatccgtgcgcctgtatttttgatggcaagcggcgttttatcatcaggatccacgctcattccacctgtgcagaatacaatttccgctccggcttctatcgcgcgtaagcatccgtctgtgatttttttgtcatcatcatcaaacacctcatgaaacatcatctgtgcgccaaactctgctatttttttttctataacaggtgtaaatgcatcctgtatcctgccatggtacacttcgtttccggttgtaattattgctgcttttctgaccacaaacggcttaatatcaaggattggaccatcctcacatatattagaagcttcctttagcttatctttttttatgacaagcggtatgattcttgttccggcgagcttatcaccctttttcacagtggtattgccgtgccttgtggctatcatcagctctccaaaggagttgaccttttcaagctttttgctatccaccttaagcagtccatcacagtctgcgattacctctatcttgccctcctttacggaggacggatgcattttactcgcagtgccgcaagaaacgcctgattgtgtgtctgcttcaattttctttgtgccacatgcgctcatacgataaagcacctccgcagcctcattctcgtgcatcatggtctcatcattttcccatatatatatggtatcttttccgacactaagcagcaccggtatgtcctcttttgttatgatatgccccttgcgaaaaactgcatcctttttcacgccgggaataatctgtgtgatatcgtggcagagcacctgtccgactgcctcagttgtcttcataagcttcatataatcccacactccaattattatctctgtaaatattaactattccaaaccacacctagtacaccgaccgcactcactgtcatactgcagtaaaatatcaagcccatgctctatatttcccatcagaaaatccatgctctccgacactgccttcacactgccgggcagattaactatcagtgtgtttttcctgatgacgcaaacgcctctgccaagcatggcgcgcggtgtaagactcatgctgtacgctctcagtgcctcagcgatacccggtgcattgcgctgtgcaacatccattgtagcttccggcgtgatatccctaggtgaaaaacctgtgccgccggttgtaagcaccagattgcatttcatgtcatcactcaacctgacaagctcgtctgcaatctgttttctctcgtccggtatgattttatatgaaaccacctcgtactcatctttgggaagcatctgtcttattttcgggccgcttttatcctcgcgccgacccgctgcgcctttatcacttatcgttataatccctacagtatacattacatcaccctgttatccttgattaaatgtgtatttttaactattcagctgtatagtgtccactctttccaccggatttttcaagcagatgtatctgcccgatttccattccacggtctagcgccttacacatatcatatatggtaagaagcgccacactgacccctgtcatggcctccatctctacaccggttttgcccacacaggctgtcgtgcaaattgccatgatactgctgtttttttcatccagctcaaactcaacatcacactttgtcatagcaatagggtgacagagcggaataagcatggaattgttctttgctcccatgattcctgcaatccttgccactcccagcacatcaccctttttagccgtgcccgtagatacagccctgtatacagcgtcatttacctttatcgtgccgcaggctttcgccacgcggtatgtgtcatcctttgcgtgcacatccaccatgtgggcttcccctgcctcattaaaatgtgtgagcttttctttattttgttcctgattattgatatctaatccgttttgctgcgtcaattaattaatcctcattgtaactgttcagttaccataatttattatctattagtaactgcacatttaataaacccttatgccgtgctcaaatgccgataccgcctcaagcacactgcctgctatactccttgccttgtcagagatcgtaaaacaatttgaaagctccccttcgcgtggatcgatatccgctatcttgaagccttccttgaaataataaccctcacggataagacctcgtatgatgcctgtaattgtagcatttaccggaacatattcagacaatttattgtcatagcttcctttatccggatatatccgcgctatctcatcgcccttttgcacaatatctccgatttttctgacatcataaatatatcctgctgccggagcgtgtatcacacgctcacttgtgaagcctgcgatatttcccggaacccctgtgttgggctgtgccatgccatcggtaatgatgcgcgccagattgtgcccacgcatggactcaatcaccagatgcacgtccttgcctgccgtaaagcccggacctactcctatcacaagcggtgccatatttattgtggtgcccagatttttctttgctattatggcatctaccacaacatccggtctaaaaagtgcaattgattcaccggttgggtctatgagaagcggaacctctccggcttcaagcacagcttcgatagctgagctcttccacttttgcgatgcaatatgagcttgcggtgtgtcatttatcccggaaattgtctctgcatcattcaaggcaggaagcagtctggctgtcagaccctctacagttgcgctcccatcatacactgcctcgcaaaaggacacctgacgccgtatggctgccgaatagtctgtctcaagcgctatcacccgatgtcctgcacggtgcagtctgtggatgatgcctgtcgcaagatcgcctgcaccacggcatatgattaacaaatttttcttttttatttgattattgctcatataattagttaccctgttaacttattatttccatgtttatctgtaatatgtcgaaatccgtcctttaaacccgctgtcgcgaagctttttgacatagacctgacgcagcgtgtctataaccgagtcatcaaccactacatcctctgccattcctagctcgttttgcataagctcatatctgaacacaacgtctttacacagcttgcccttttcccacgtgccaagcactatgataacatctgtggtgagcggatatacgacaggctcatccgctgccggatatttgagagaatggtgctttgctccatctgcttcgattataacataatctaacgcctgtggcatgtctttaatcagtctatcaagcaaatcatacggcagtccgcacatttttggctttgactgttctgatattttctgccccgccatgcaatatccatcttttattattttatcccttaacgcaaaaaaatcgcaggataggtcagtgtcagcttcgacatacatgtgcgttgttgttgtgacaagcacaccttttcctctcctgtgatattcccttgcaagcttatggacgagtgtggtctttccacctgcgcccactattgaaatcactttttccatatatttccatactttcccacaaataataaagccgccggtgtacttaatgcaccggacgactttaaaatcctaagcgttaatcatccacacgcttcacatcatctttttcttccatatcccacatatatggtgcgttcttagatttcttcggcaaaataatattgagaagaatagcgcaaagtgagcaaggcacgatacctgaaccgccaaatataagctgtacatagtatggcaggtgtgatgtagcacctgttgtagcgccaagtccgtagcctaaaccgattgcaactgagataattgtaatctcacggctgccgattggctcctttgtgatgagctcaattccggaaatcaggatagaggcaaacatcataaccgcagctccgccgagcaccgactgaggcatgattgacatgagagctccaatttttgggcagaagccgcaaatgatgaggaatatagctcccattgaaatagcaaatctattgacaacctttgtcattgaaacaagacctacattctgtgagaatgaggtatttggcagtactccgaaaagcgctgcaaatgatgaaccaagaccgtcacagataacaccgccggaaagctctgaatctgtagcctctctgtccattccaccctccacacaggctgagatatcgccaactgtctctattgcagtaacgataaacatgatgccgattgggatgattgcattggcatggaaggaaattcccacatctgaaagctttccaaagcctataaagcttggaactgctatccatgctgcatttttaacctcgtcaaagtttactacccatgaatatgtgtatttgacaccgtcagcagtcacacctgtatgtgacatggtaagtgtcataatgattgctacaacatatcctgccagaataccaaaaaggatggcagatgatgaaaaaatactgcgcgacggtgcaaaatgcttaagaagcacgattactataagtacaaccattccaagaaaaaggtttggcagtgagccgtaatcatttttgcctgtgccaccgcagaagtagttgattcccactccaaggagtgaaagtcctattgctataacaactgagcctgtaacgattgcagggaaaaacttgcgtaaaggctttaagaaggctccgagtatgccttcgaaaatacctcctacaatgcaggctcccataatagctccatatgctataactccgccgccacacgctgcaactgtattatttaatactccaagaaagcccgaagaggttcccataacgataggcacctttccgccgaccggtccgatggaaaacatctgtactaatgtgacaatacctgcgataatcatggcattctgtaagagagctgttctaagctccgcaaagcctgcgtccgctgtgagtccacatgctcccataactatgataagaggtgtaaggtttccgatgaacatagccataacatgctgcagtccaagcggaatagcctgagacagaggtattctgccctcaaactggtaaggtgaagagtttgttgtctttttcattggttcctccaaatatttatactcttatttaataaaataatcacaaaattattttacgagcataaggctatgcggtcaatttagtattacttataatataatatccatctacttataaatacatgctattgaaatccagacatatccatatcttcgagagacatctcaacctttactttctgcgagtcgattatacccttggaaagtaaaacaacagtttctacatgtccggtgtgagcgaactggtcaaatgcccgcactttttgcagctcatatccaccgtctactaaaatacgcagatctctggcaagcgtagcagaatcacaactcacatagacaatccgctccggacgcatggcaagcatcgtggacaaacactgctcatcgcaccccttccgaggcggatctaccacaatcacatccggatggcgcataccggcatccagatcgtcactgttataaaactgcggcaatacttcctctgcttttcccacaaaaaactctgcattcgtaatgccgtttaatgcagcattagtctttgcgtcctcgatcgcctgcggaacaatttccactccgtacacctgccttgccttctgcgacaaaaataacgaaatggttccaatcccacagtacagatcccataccgattcttctccggtcagccccgcatattccagcgccgtactataaagtttctccgtctgtaccggattgacctgataaaacgattgcggagaaatgtgataggcaatcgccgtatctttcacagaaaaatcatttgtattgcgcagatggatataatccgtgatataaggcatgccccagatacattccgtgcgctttccaagaataacatttgtgcgctcggtatttatattataagaaatagaggtcatccccggaagcaccgaaagccgttcgatgagcgcgtctttctgtggcagcccgtctccgttaatcaccagacataccatcacttcttcggtggtaaatccatagcggatcaaaacatggcgcaccaacccggttccggcagcctcatcgtaagccggaatctgtgcctgatacatccactcctttactgcagacagcacatctttattttcctttaccccaagcagacagtcttccaccggaatgatggcatgcgtacgtgccgcataaaatccggtcacaagttttccttctttatccagtcccaccggaaactgtgccttgttgcggtagcggaaaggatgctccatcccaacgatcggcagacacacccgctctaactcctctttggaaaatccaccaatcctctgcagattactgcgcaccttgttttccttgaatgcaagctgttcctcgtaggaaagtgcctgtatctgacagccaccgcagcggcggtgcaacggacattgcggttctacacggtatggagatgatgtgataatttcctccacacgggcatatccataatgttttttcagttttgtggcacgggcacggatttcatctccgatcagcgcatccttgacgaaaaatgtcatcccatcgtactttccgatgccttccccgtcgactcccatatctgtaattttcaaagaaaataaatcgttttttttcatccttttaacctgcgaagtcggagtcaaaatatctttcggctccgactttatctcatcttatttgcttgtcttgcgtatatttgtctccagcagacggctgtacccctgccattcaagattattgtccggtacatttgccagaatctcccgcatggtttccatctttgcatccacgttgtccgcgaagctcaaagccatcgcttcaaccagtgccggtttcttcggagatccatactccagttctccgtggtgcgccagaatgcagtgctttaactcattttccagaaccaccggaaatccttcaatggaacggattccctcgcctacccactcggcaccgatcataatatgcccaagcagctgtcctgcatcggtataatcatttgccggaaacgccgacaactcttttaatttaccgatatcgtggaaaatcgccgccgtaatcagaagatcccggttcaaaaacggataattctgcgcaaaataattacagtttcttgtcacgctgacggtatgttccaacagacccccgacaaatccatgatgtacactctttgctgccgaatgaaatttaaaccggtccacaaatgtttgattgtcgaaaaatctgtgcagcagctggttcaggtaaggatttttcacagaatcaatatatcctgtcaattcggcatacatctcctccacatccttgtccgtacaaggaagatactccttaggatcaatgtcctcctctgaaacacggcgtgcacgccggatcgacatctgcagatttccctgaaagctggtgacatctcccgtaaccgccacataatccagcgcgtcaaactcatcaattcccacagaacccggatcccagatcttggcatcaatcgttcctgttttatcctgcaggatcacattgtcgtatgcttttccggctttggtcagtgccgcctgtttgaatttacacagatatacttcatttactttttctccttctcggagagattcaatatatttcataataactccttatttccaattttactgcaaaacccctgcttttaatttacaggtaatctttttataccccctagtaccttcccgcataaccgtaaccgaataggtttctttcggtgtcagctgcaacagcacctcccggaattgctctgcacttgcaacctcctggcctgcaacggaacggatcacatccccgctctgcagtcccgcatccatggcaggcgaatctatctcaacttttttgatatatatgccctttggaatatcgtatttctgcgcaatatgctgggtaacagtagaaatgtgcacaccaaaatacggcacctctttgtccgcaaataatagatcaatcactggcatcagttctgatatttccactgcagtgagcgtatttgcagaagccgcactatagctttgcatcacaacaccgacaagttcgccatccatattgatcagcacaccgcttccattctcgctggcaacaatatctgtcgtgtatacactgtaattattgtccggggtggaaatttcattattggtcgctgtaatagttccggtcaggatcgaataattcgttccaagcggactaccgagggcaatcacaatacttcccttatgtatggtgtttaaaccagctgttttcatcacggtgatggcattcttcgtggaatcttccagatcctccagatccacggtaagtgccgcaagaccggtattcccatcgtatctgaccagctttgcctctgccaccgcatcatttacaaaggtaactttgatctttgcagcatctttaatcgtttttttctccgtaagaatccagagtttacctccactttctccaatgatcgtgccacaaccctgaccttcccgttcataagagttgttaaaccagtccgtatcactgaccacccctgtgatcgtaacgatggacttatttgccgtatttccaatggtgtacagctctgtctgaatctgctggtaatcgtccagcgtcatcggctgtctctcttccggagtctgtgtctcctccttttcctcagacccctgctccgtttctttcaccgatgcctgctgtgaatcctgtgctccggtatccggcacagaaccttcctcctgccgcagaaccggaatcataaaaagcagcaccagacacacagccagcgcaaatacacccccacaggcagcagattcccccaaccggacccacatacgtttataattctttggtttgtccttaatctgttctctgacaaacgcattctttggttgctgtttatcactcataaccactattatattcgcatttccatgcacttgcaacaatcacattatttttcttttccaaaatggcactttgcgttataatacaagagagaatactatataaaaaggaatatcactatgaatcagaaagtttatcatacacttgaatattataaaatactggagcgtctggcagattatgccagctgtgaagaggcaaaagaccgctgtcacaaactggttcccctgaccgatcctgcggaaattgcacatctgcaggaaactacggcagacgcactcagccgcctgtaccgcggaagtggcatcagtttttccggcgttcacaatgtcaacgcttccctgaagcgtctcgatatcggtggcaccttaaataccacagagctccttatgatctgttctctgttggaagttgccaagcgggtcaaagcatacgaccgaagcgaccgcaacgatgaaaaaacagattccctgtcaccgcttttttcacagatccagccgctttctccccttttggatgaaatccgccgctgtgttgtcggagaagacgaaattgcagacgacgcctctgcggcactttctaaaatccgtaaatccatccgggggatgaacgaccgcattcacgcacagctgactggtcttatgaacaacacaaccacccgcagctatctgcaggatgctgtgattaccatgcgtgacggccgctactgtctgccggttcgtgccgaatccaaaacctcggttcccggtatggtacatgaccagtcctcaagcggttctaccttatttattgaaccaatggctgtcgtcaatttaaataacgaacttaaggaactgtttttaaaagaacaggaagaaattgaccgcattttagcagatctttccaaccgtgtggcagaaaacgcaaacggaatccgtcaggattatactgttcttgcggaactggattttatttttgccaaagccgaacttgccaaaagttacaacggtgttgcccctgtctttaatgaagaggggcggattaacatccgcaaaggccgccacccactcttagatcctaagaaagtggttccgattgatgtacgtctcggtgcggatttccggcagctgatcgtgaccggtccaaacaccggtggtaaaaccgtctctttaaaaacggtgggactgctgactctgatgggacagtccggtctgcacattccggccggagatcgctcggaacttgccatttttcacgaaatttttgcagatatcggagatgaacagagtattgaacagagcctgagtacgttttcttcccacatgaccaatattgtccgcattttacaaaaggcggatgaccagagcctgtgtctgtttgacgaactctgcgccggtaccgatccgaccgaaggtgccgcacttgccatctccatcttaaacaaactgcaccagtatggagcggtcaccatggctaccacgcattacagtgaattgaaagtttatgcgctctccacagaaggtgttgaaaatgcctgctgtgaatttgatgtcgatacgctcagtcctacctaccgtctgctgatcggtattccgggaaaaagtaatgcgtttgccatcagttccaaactcggactggcagaaaatatcattgaagatgccaaaggccgcctgagtgagcgcgacgtcaatttcgaagatatgcttgccaatctggaacagagccgtatcaccattgaaaaagaacagctggaaattcagaaatacaaagcagaaattgaagatttaaagaagaaactgaccgccaaaaatgagcgtctggacaacagccgtgacgagatcctgcgcaaagccaatgaagaagctgtacagattctcaaagaagccaaagaccttgccgatgagaccatccgcaatttcaacaagtacggacagggacaggcgcctatgtccaaaatggaaaaagaacgcagccgtgtacgtgacaaaatgagtgccagtgaaaaagcactctccatgaagaaaaaggaaacggtcaaccacaaagtacctaaaaagttgcgcatcggtgattccgtgcgtgtactgtccatgaacttaaagggaaccgtgcacacactgccaaacgccaaaggggatctgtatgtccagatgggaatcttacgttccctggtcaacatcaaagatctggtactgattgatgaagatgcctctccggcggcaaaaaaatacggaggtacttcttccggaaaaataaaaatgagcaaagcggcatccgtttctacagagatcaatctgattggtatgacggtagacgaagccattgcccatctggataaatatcttgatgatgcctatgtggctcatctgccatccgtccggatcgttcacggaaaaggaaccggtgcactgcgcaatgccgtacaggcacatctgaaaaaccagcggtacgtgaaatcttaccggatgggagagccgtctgagggcggtgccggtgtgaccattgctgcttttgatgtttaaatacctattgattttttataataaggagggatttccatgtccaaacagaaaatactgattgtggacgatgacaataatattgcagaacttatttccctgtatctgaccaaggaatgctatgataccaaaatcgtcaatgacggggaagaagccctgcacgcatttgaacactataaccctaacctgatcctgcttgatctgatgctcccgggcattgacggctatcaggtctgtcgggaaatccgtaccaaaagcaacgttccgatcatcatgctttccgccaaaggcgaaatctttgataaagtactcggactagagctcggtgcggatgattacatattaaagccatttgattccaaggaactggtagcacgcgtcaaagcggttctccgccgtttccagcctgccaaaaccgagtccgttgtagaattaaaatgtgtggaatatccggatctgaccgtcaatctgtccaattattcggtcatgtacaatgggcatccgattgacatgcctccaaaagaactggaactgttatatttccttgcagcttctcccaaccaggtgtttacccgcgaacagctgctggatcacatctggggatatgaatacatcggggatacccgcacagtagatgtccacgtcaaacgtctccgggaaaagatcaaagaccatgaaacctggtcgatcgcaactgtctggggaatcggttacaaatttgaggtaaaaggatgaaaaaaacactgatccccaaactcattttcggctatgtcctgtttgtggctctcggctttatcatcctgtgtacgttcacacagcatgcgatcacgcattatgccgaaaaccgggaggcacagcagctataccgggaatctgtacagattgcatctggttatgctgacaattataataaatacagtttttcgttgcaggattttcaaaaacagatgcaaagtcttggcgaatatctttctgcccaaatctggatcatggacaatcagggaaatattctttttgattctaccgatgaatccgtcggcaaagatgcagcaaatgccaattataaaacgctcaaaggtttcaacacttccgactttggcaaccgttattatatgaccggtaacttttacggatcgttttccgaaaaaaaccttacggtattttctccgatcaccagcaattaccggattcacagttatgtcatgatccataagaccgtgtcctccatcacacagaatgcaaacggttttatgaacattgttttttataccattgaatttgtttttctgacagcactgttcctccttttgctgtttgcacatggattttaccgtccactgcaccggctgacaatcgtctccgagagttatgccaaaggaaattttgaaccgcgcacacagatccaccggaacgatgaactgggatatcttgccaacaccatggattatatggcgaatgaactggacacactcgaagaagaccagagaaagtttatctcgaatgtttcccacgatttccgttctccgctgacatcaatcaaaggatatatcgaagccatgttagacggaaccattccaccggagctacagaataaatatctgaatatcatcctgtttgaaaccgaacgtctgaccaaactgacacagggaattctggatctgaaccgttttggacagcaccggggtatgatgcttgaccttacagatttcgatatcaaccgcatgataaagacgaccatcctcacctttgaaggaacctgttctgccaaagggctttcttttgatcttgtcttaacaggacaaaagttatatgttcacggtgatatgagcaaaatccagcaggttctctataacctgatcgacaatgccacaaagttttcccacaatgatgcatcaatcaagattgaaacaagcatcaaaaatgaaaaagttcttatttccgtgaaagattccggaatcggaattcctgcagaaagtatcaaaaaaatctgggaccgcttttataaaacggacctttcccggggaaaagataaacggggaaccggcctgggacttgctattgtaaaagaaattattcaggcacacaatgaacatatcaacgtcatcagcaccgaaggagtgggaacagagttcatctttaccctgccactcgcaaaaaaagaagtacagtcataactgaccgtacttcttttttcagtcaatggtaagttcctgatccttccggtcatacacactgcgatacatctttgtatctatgctttccttatccagagaccatttattttcttcttccatggcatcttcccgcagcagatccgtttcaaaccgatacccttccgttgtcacagcccgcagatagatacgcagtggtttccgcgaaggggtttgtccttcctgtgcctgcgtctgttctacgtcttctttctgctgctgtggcttctcatataccatcctgcaggtaacggtaccggaacctgaatcaacggtagatccttccgaattctcctccaccgcctgttctgtcgtcaccagatccttatcgtcctttgatgactcctgtttttcctctagcagattctgcatcagatcctgcgtccagatttcctctccatccagggatgctgctatttcaaaacttttaaaatgatacatcgcaacattatcaagcgtataggtacactttcctttcagagaaagttttccgtcctttaatgccggcgttccatctaaagttcccgataaaacctgatcaaattttccgctgacaccatcaaagtcttccaccacttccgttgtcttcttttttccgtttgcaagaaggaacgtgacatttccgttgaatgttttgttaagcggaagtgtgatatttcctttgaacatgtaaccatctgctttcagcggacattccgttgttccgaaatagatgctcatcgttgtattatcggtatactctttcggaatcacggaaacttccaccttatactcgtgacgggcaaaatccatatcctttacttctatggaataatcctcgaccatactggcctcttcttcgagtgttttttcaatgcttgactgcattcctcctacatccgaaagaatgatgttggtcgtatcctgcagataggcaagctggttggtcagctcactgactttgccatacatcagaattccaaacaccaaaagcaagataaggatcagtacaatgagtatttttttccagtttgctttccattttttcatagaaattattcttcgctgtcctcactctttacgatcgcaataccaagttcttctaactgtttctcatccacagaacccggtgcctcagacatcagatcggaagcatcctttaccttcgggaatgcaatcacgtcacggatggaatctgcatgtaccatgtgcataatcatacggtctacaccgtaagccagtcctgcgtgtggcggcacaccataggagaatgcatccagaaggaatccaaactgctcatgtgcgcgctccttggtaaatccaagcacctcaaacatcttttcctgaatgtcatcttgatgaatacggacagaaccaccaccaagttcggtaccgtttaatacgatatcgtatgcctttgcgcggacagcacccggatcgctgtcgatcttatcccagtcctcttccatcggcatggtaaatggatgatgcattgccataaaacggttctcttcatcggaccactccagaagtgggaattctgttacccacaggaaattgtacttgttctcatcgatcagtccaagttcttctccaagctgtaaacgaagtgcgcccagtacgttccatacgatcttatttttatctgctgcaaacaaaagcagatcgcccggcttgccgttcatctttgcaacaagtgcgtttaactcgtcttctgtcataaactttgcgaaagaagacttgtaagtgccatcttcgttaatgcacagataagcaagtcccttggcaccgcagccctttgcatgctccaccagcttgtcaatcttcttacgcggcatatgtccctgtccctcgacattgataccacggacagaaccaccgttttccagtgcaccggtaaatacaccgaatccacagccctttacggtctcggatacatcgaccagttccataccgaaacgggtatccggcttgtcggaaccgaaacgatccatggcttcctgccacggcatacgctgcagcggaatctgcacgtccacaccgatggcttccttaaatacaaattttaacagacgctcgttgacatcaatgacatcgtcgatatcaacaaaggaaagctccatatctgcctgtgtaaactccggctgacggtctgcacgcagatcctcgtcacggaagcagcgggcgatctggaaataccggtcatagccggatgccatcagaagctgcttgaacagctgcggagactgtggcagtgcatagaaatttcccggatgcacacggcttggcacaagataatccctggcaccttccggtgtggacttgcacaggatcggagtctcgatctctaaaaatccctcgtttgccataaactgacgcatcagtccgagcacacggcttttcagcattaagttcttttgaatgtccggtctgcgcagatccagataacggtatttcagacgaatatcttccttggtctggctgttctcctcaattgcaaatggaggtgtctgtgactcggataaaatgcgaaggctggttgcgatcacttcgatatctccggtctttaagttttcattgactgctgcagaacgcttctgtaccgttccttcaacagccactacatattcacttcttaaagttcctgcctttgcaaatccctctgctccgacactctcctcatcaaacacgatctgtaacagaccacttctgtcacgcaggtcgataaaaatcagacttcctaaatttcttctcttctgtacccagcccataacggttactttttcaccgatgttggcactgcttacctcggtacatctgtggcttctgtgtaagcctttcattgattctgccatgattgtctcctttatactctccttattctatctgttaaaaaactcctcaaattcttcgtatccttctttggaaagctgctctttctggaatttcttgttcttgttcatgcggacaaccaatacctgctgtccgttctcacgggcttcttttgcctgtttcatcacatccacaagtttctctgccggatacttcttttctactaagtaagcaactctcttcggacgctccggaattttgaacccgctctccatcagaagcaggataatacgctcaaatccgatggaaaaaccacatgccggcacatcgttgcctgtgaattttccaatcatcttgtcgtatcttccaccgccgccgcaggctgcaccaagctccggcattgcgatctcaaaaatggttccggtataatagctcatgccgcgcacgagtgtcggatcaaagaccagtgtaaactctgcattctttgtcgcattgactgccgttgcgatctctgtcagactgtccgccacttcctgatccagaaaatctcccagcttgtcctttaagaatgccacaccttccgcaacatccttgcggtcttttaataactcaaacagctctaagtatttgtcaatcgactcttttgcatagccctcttccccgagttctgctgccacaccttcgagaccgatcttgtccatcttatcgagggtgatgaaaatgctgtcgtaatccttctcttcaaatccgctgtatgctgccattgcctttaaaatccggcgctcattgatgcggatctcaaaattcttaaatccaagtctgccgatggtagtggttgtcgcggtgatcagctcaatctctgcaagattactcggctctcctaaaatatcaatatcgcactgggtaaactgacggtaacgtccacgctgcggacggtcggctctccacacgcttccgatctgcagtgccttaaacggtgtcggcagatcattggcatggtttgcatagaaacgggaaagcggaacggtcagatcgtaacgcataccgaaatcgaccacatccgcctcttcctttgcggtctccagatttaacttctccccacgctttaatactttaaagatcagtttctcgttctcgccgccctgcttgttggaaaggtttgcaatattttccatgcatggggtttcaatcggcgtaaatccaaagctgcggtaggtatctttgatcacgcttgtcacataatcacggatttccatctctgcaggtaatatatctttcatgccgttgaccggctttttgctcagtgccatttgatttcctccatttttttctctttttatccagcatttattatacgtttcggggcctgatacgtcaaggattgttgcaaaatgctttttcaatcagacaactgtgttctttcgtttcctgattgtagttaatccctactaacagaatatttccgtgatagtttttcagcacattcatataattcttttcttttatctgtgcaatcgcagcttcttttgttttattccatttcaattctacaagtaaggcaggtttatccactcccacttttggataaaacacaagatccgctattccttttcctgctgaaagttcttccattttcgtgtaataatccacactgcttaaatatgccattttcacaacacttcgaagtgcctgttcattattataaaatacagttgctgtatcctcgtcatgaatttcattaatcagctctgcaaccgttccgccatccatctgccaggttgcccttaaaatatcgtctgaccgctggattgctctcataagctctgtgcggtttccgtttttaatggcacgtataaattcctgccggatttccaccttcggaattcctaccatctgtttttcttcatcatatgccagatatcccagatggatcagcagtgtcagcacatcgtccttactcttcatggaggtcatgtcattttggaaagatcctgtatccacttcgcagaccgctcctccgagcatatcgataactgcatctttcagaccgtcaaaattcatatcaatataatcccgcaatgcctcataagtttctgtctttgtccagtagctgctgaatttatttcgaagaattgattccataactgacttcggattataaacatgtatccctccaacaaaataaccatcataccactgctgcatgagtgcatagtctttctgatattttttacaaagcatttccacttccgtctctgtgaatcctatatattcctgcaacggacagggatctaccatggtatattcataaaaatcactgaccgcagattcatgaccatattttttaatcggtaaaatacccgtcatgtaaactccggaaaaaagctgatccgtcaggctgcttttaaacagcgaacgcagtaacagaatataagcatccagaatgtgcgtctgccccttacactcccgaaacatggcatcccactcatcaatgatcaaaatcatcttttcttctgtcctttcgtgaaatgcacataatgcatcgaccagatgctgctcttttcccacttccggatatacttttcccagatcatttatgatttcctgctccattctctccaccagcatatcatcctgctttaacgtagacaaaaaaagcgtgatatcgagatataatacctcatactgattcaggttctttgcaaatgctggatcttttgcaatctgtaaatcctcaaaaagttccttggaatcgcaccccttgctgtaataagcacacagcattttagttgcaaatgacttgccgaatcgtcttggacgacttacacagatcagtttttgaggcgtgtccagacacttgttcataaaacgaatcaatcccgttttatcaacgtattcactgttccggatcgaacgaaatccttcatttccaatatttaaatattttccactggctgctgtcgatttctgcatctgttcttctcctttatttgcatctaattataatgcaaacgagggaagtaagcaatgtttacttccctcgacttggattggtcacttagatcgtccaagaaaatgtccgcaccctcccgtcacgaaattgatctgtttcatcagttactttctgattatattttaaggcagatgtgaatgtttccatttcacatctgccttaatgccgttaatacccatttattttaattcatcttccagcaatactgctgcgtcctttacacagtcaatgcattctctcctgacaaccccatctgcaatacctttgagttctttacagataacggtaccattttgttctttgaatctgctgatgattcgtcttgcactctgcattgttttctgcggatttttattgatcatccccaatacatttactgctccgatgattgctccgcatgttgcttccatactgccacccatgcctactgcaaatccctgtgtaagatttttgactgtttcttcatccaaccctgcctgttcacaatacgtacatgccacagcctgcgcacagttataaccacacatttttctttgaactgcctcttttacttttgattccatctttttctttccttttctttttgtaattaggaaggggatttcatccagctatttttctgagaacaactgctgcttgcgcgcaatcatctcatcaatcctcttcatatacagcccgacatctttaacattttcacaccgctcgatccggtgtgtgccatccgcattcggctgcggccatacccgtttggtggatgcccctgcgccacaggcaacgattgtctggcgttcctccatgattaacacgttatacacccctgccttgcccggcttggcatatccaacgttttccatatttcccgccattcctttctgacggtacagataatacggagagagtcccatctgatgacagtattcggcacacagatccatgtgctcctgcgtattgaccatcatcatgctctcatagcggtctttgaaaatgtttaaccgcgccgcacgcttgatggcaagtgaatggatcgtgatattatccggatcgagttcttttaaaatctccatcgtatttcgcacatccgcaaggttctcttccggaagccccataatcagatccatgttgatattgtcaaatcccagttttcttgccatgcgaaaactttctatcgtctgttcgaccgtatgatgacgtccgatcagatcgagcgttttctgcttcattgtctgcggattgatggatatacggctgatgccattctttcgcagcaccagaagtttttcttccgtgatggaatccggccgtcctgcttccaccgtaaattccagacaatctcccagatcaaaactgcacctgatcttgcggatcagacgatccagctggtatggctcaagtgtggtcggtgtccctcccccgatatagatcgagttcagtttgcgatgataattctttgcggcaacataatccagttccttttccagtgcgtccagatacgcatcaacctgtgttttccaggcagtcagcggataggaagtaaacgaacagtacagacaggtgctcgggcaaaacggtatgccaatatacagactgtatccattcttataatccagccgggaaagcaatgcccgctcacgctctgcaatggcaatcgacagattgattttctcatcggatgccagataggtctgtttcatataggaagcaatctcttcttttgtttttccctcatcaagcatctgcatcggaatcttcgtcggacggataccggtcagtgtaccccatggcagcggctgtcccgtctcttcctcaagcaggcggtacagatgttccttcaatgcattctttgtctctgtacgattggaaaaatccaccgcaaaggtgcgccgcgccggaccatccggcgcgtcatcccaggcgatggaaattctgtcatccgcataatcaatcgaaaaatgggaactccccgcttcttcctgctccgcagaatgattggtacacgccacatttttttcgtccgcatgcgcttccttcgtatagtaaagctccacatcttccttcgggaaaaacgctttaatcagcgaatgaatatcatattcaaattctgttctgtttaatgttacagtaatcataagtatggattgtacatcctctcgttttcaatggtcgttacatcgttgtgtcccggataaacggtcgtgcggtccggcagtgtcatcagcttttccttgatggaacgaatgatatcagacatgcttccgcccggaaaatcggtacgtcctaccgatgtgcaaaacagtgtatctccggaaaataccacattttcgtatgggaaatagtaacagcatccccccggtgtatgtcccggtgtgtgcagtacccggatatgaaatcctgccagatccagttcctgctcatcctttaaatatatgtccgcatggaacacgtggtgttcccctgtcatgtggcataaattcatctcttcgttttccagcgtttctttttccgtctcataggcatagaccggaatcgaaaattcttttgccagatctgctgctccggttgcatgatcaaaatgtccatgtgtcaacagaattgccaccggtgtacatccttcctgacgcacacgctccgccagctgcttgggactgtagcccggatcaataatgatcagttcttttgtctcatcattgattgcaaaatagcagttggtctgtaccggccctaccacatagtgatttatttttaattttgccattctcttcctcctgtcggcgcaaccttagccggtcgtccgctccacatccatcacgctctcaatctgtcggatcttttccacaatttttgtgatctgtcccttgccttttgtctggaaggccacatcaattgttgcgatcccctgcttgctggtcttcgagtgaatcccggaaatattgatctccgcctctgtaaatactttggtaatatccacaagaagtccggaacggtcgtgacagaaaatcttgatttccgcatgatactcgccaaactgttctttgtctgcaccctcctgccactcagcttcaatcaggcgcacacgctccatatcggacaaatgcagaatattgacacagtcggtacggtggatcgacacaccacgtccgcgggtgacaaatcccacaatctcatctcccggaaccgggctgcagcatttactgaaatgcacagccacatcataaagtcccttgaccacaattccgctcttggaatgctttggcatatcctcctgcttattctccccaacagcctcaagcacttcctgatctgtcagcgtaatcggatgatccttgcggtattcatcgtacatacggtttacaatctggctttctttcaatcctccgtgtcctacggttgccagacaggaattccagtcatggaacccgtatttgcggataatctttccctgatattccggcttattgatttctccgaaattgattccctttgccttggcataattgttaatcagttccttgccgtgcagaatattttcttcttttaattcgctgcggaaccactgattgatcttgttcttggcctgtgtgctcttgacaatggaaagccagtcacggctcggtcccttggagttctgggaagtgatgacctcaatccggtctccgttctggatcacatagtcaatcggcaccagcttgccattgactttggcacctaccatcttatttcccacagcagagtgaatgctgtacgcaaaatcaatcggtgtggaaccgtttggcaggttctttacatctccggacggggtaaaacagaataccgtatcggaaaacagatccagatcactctttaaaagtgtcataaactctttattatccgacatgtcacgctgccactcaaggatctggcgcagccagcttaatttttcttcttcggttacggtcgtggaagtggttaccccattgttcacttccttgtatttccagtgcgccgcaataccgtattctgcggtacggtgcatctcaaacgtacggatctggatctcaaacggctgtccgctcggtccgatcagtgtcgtatgcaaagactgatacatattcggttttggcatggcaatatagtctttgaaacggcccggaatcggtttatatttttcgtgcatgattcccagagccgcatagcagtcttttacggtatccacaatgatacggatggcaaacaaatcataaatctgatcaatggtcttgttctggttcaccatctttttataaatggagaagaaatgcttggcacgtccggaaatctccgctttgatgccagcctcttcaatttccctgcgcacatcggcaaccagtccctgtacataggcatcccgcacatttttgcgcagtgcaaccttttccaccagatcatagtaagcctccggctccagatatttaagagaaagatcttccagttcaatcttgatcttgctgataccaagacgctgcgcgatcgggcagtaaatctcctgtgtctcacgggcgatccgctgctgtgcctccttggactggtattttaaggtacgcatattgtgcagacgatccgccagtttgatcataatgacacggatatctttcgccatcgcaagaaacatcttacgcagattctccgcctgcatctccaaccggtctgcattcttgtccttcggatttttaatattatccgtcagatgcagatgctgcagcttggttacaccatccacgagaagaaggacttcatccccgaattcctcccgcatctgttcttcggtcatcacggtatcttccagcacatcatgcaacagacccgcagcaatggtttccttgtccagttccagctctgccagaatgattgccacacagagcggatggataatatatgcctctccggatttacgcacctgtcctttgtgcgcctcaaaagcgacatgatatgccttttcaattaatgtgatatccgtggagggatggtatttccggatacttgcaatcagttcgtcatacaagtcctccggcttggaaaattcctgaattggtttaatgttgtcggaacccgaatgatactcgcgctcaattcgttccagttcttctgtagaaatatctgccatgcgttcacctactttttccatatgccataatataatagattattataatttataatttttcatattgcaatggtttcccctaagaaaactcgtagatatagcgttgtgtccggctcccggaaacatctgtatcctccagatagtaaaatcccagtttctgaagaagtgccacagaagccacattcttttgatccgtcagggcattgactctgggaaaatccagttcttcccgggcaaatgcaagaattgcctgacacacttccgtggccagtccctgtccctgtctgtccggatcgatcagatatcccagttccagttccacggcatccggaaattcccggtgctcgagtcctgccctgccgatcagttccccggaagctttatcaaaaaccagccacatcccatatccatagtatccgtacatattggtaatatatgcctgctgatattttttttctttttcctttgcaaacaatggttcaataaatcccggaatcctctctccgtctgcatccagacgccatgttaccccttctttctgatacagtttttccagggcgggaagatcttccagcgacaattcccggatcacgcaccgtttcgtgcgcgcaatctcccacggctggccatggcatctttgaaaaatccgctccagaaattcatcatccacttcctcaaaaccttcaatcaccatccaggcgcccgcataactctgtcccggaaatgccggatctgcataggcagccaccgccatatgcgcacggactgccgcctgaatccctgcatctgtcgacgtaatcaggaggacttcctctgcatgaagtttccacacagcaagcgcttcttccgttatgttttccaccggaaataccggaaagcctgtggacaattgcagaggattccattctttctgttgatagaccagtgcctttaatttcatcctgtcaaaaaaggcagactctttcgaatctgcctctcctttctaaatattacacggtttccggttccggatattcttccccgaaggtatccacaacaactgttttcatcacctgatcttccagcggacgatcactgtaatcggtagcggtctctgcaatggcatctaccacatcctgtccctcgataatcttaccgaacgctgcatatgcgccatccagatgcggagcgtctttgtgcatgataaagaactggcttcctgcggaatccggcatcatggaacgtgccatggaaagcacgcctgcggtgtggcgcagatcatttttgacaccattctgtgcaaattctcccttgattccatatccagggccgcccataccggttccttgcggatctcctccctgaatcatgaatcctttgatgacacggtggaaaatcagtccgtcataaaatcccttttttaccagactgataaagttatttacagtatttggtgcaacttccggatacagctctgccttcatcactttgccgtccgccattgtaaatgtaactactggatttgccataatatttgttcctcttctttcttaatataaatttatttattctttggtcagtgcctcaacaacttttggaaattccataaaatgagaagccttaaccagtacggtatctccttcttttacatatgccagaagttcttccgtcatctcttcacgggttttcttataatgtacctcacactctggatttgcttttgcctcgctggcatattcctccgcaagtgtacccgcacagaacaatgcatcaatcccggaagcggcaactgcctttccgatatttctgtgaagttccttttcctctgctccaagttcgcccatatcgccaagcaccgcaatccgtctgccggatgtatgtgccagcacgtcaatggatgctttcatggataccggatttgcattgtaacagtcatcaatcaccgtcattccctttacatgcagcagattggtgcgccctgcaatggtctgcacagatgcaatgccctgtgcaatctcccggatggaaagtcccagctgcagtccgaccgcagttcctgccagcgcattgtatacattatgttcacccggaatcggaatcttcgcaccgaaatcgccctgtggcgtatggatctttgcacacattccttcgagtccatgattttcaatgtctgtcgcataaatatcttttttgatatcaaatgcggaatccgctcccacgccataaaaaattaccggttttccgtttacctcttttttcgtggaaagcttatcatcatctccatttaaaattacggttccatcgacctgcagatggtcaaacatttctgtctttgcctgcagaattccgtctcttgtaccaagattttccagatggcacaaaccaatatttgtgatcactccgatatccggccgtgccatcgctgccagacggtgcatctctccaaaatcggaaattcccatttccagtaccgcgacttcgtgttttgcgcgaatcttaaaaatagtgagcggaagtccgatctcattgttaaagtttccctctgtcttaagcactttataccgctgttccaaaacggaagctatcatttccttggtgcttgtttttccgacacttcccgtaattccaaccactttacaggataactgtgtccggtaaaaagctgcaatttttttcatcgcttctgtcgtggaacttaccagaatatagggtcccgtctcttccggcagtgcatgatccgaaagcactaccagtgctcccttttcaaatacctgcgggataaaatcatgaccatccacacgtgcccctttgatcggaataaacagataatctttttgtacctggcggctgtcggtcactgctccggcaatttccttcgtaaccaggtcccggtccccgacaaacgtcccctcacatgccgctgcaatattttcaattgtcatccccggcattttattttccagttcatttttataaaaacatccaaacacgattatccctcatactttttcatggaaatggcaatcagtttctcgcagagctcattgaaattgattccaatgacagcagcttcctgtggcagcagacttgtcggtgtcatccccggcagagtgtttgcctccagacaatacatatgattattttcatccagcaggaaatctgaacgggaataggtatccagtccaattacttcggctacctgctctgcatatttacgcatctgcgcagaaacctcctcgggcagatccgccggacaggtctctaccgcactgcccgctttgtatttattcttgtaatcgtagaagccctgaatcggcgcaatctcaataaccggaagtgcctttccttcaatcacaccaaccgagaattcacgtcccttgacatattcctcaatgaccagctcatcttcccagtgaaacgcttcatcgagtgctttcttaaactctgctgcatctctgacaatcgtcacaccgatactggaccctccgcagcatggctttacgacgcacggaagtgtcagcggaagctttgtcacatcatcctcacggttctcttttttcatggcaatgcctctcggtgcaggaattcccgcacttgcaaacagctgttttgccatacctttattcatggcaatcgcgctgctcaaataatcacttccggtatattttacaccaagcagatcaaaagctgcctgcagctttccgttctctccgttttctccgtgcagtgccataaacacgatatctgccatctggcacatacggattacattcggtccgaaaaagcatggggactgatcctttctggaagcttttacggctgccagatccggtgctacctccgggatgtcatctacttttacgctgatttcatccgcacggtcaaaaattccgtccagattttcctctttatcactgtaacccatgaacacatccagcaagatcacccggtgtccattttcttttaatgcagaagcaaccatgcttcctgtcttaaatgacacatcccgctctgtgctgagcccgcctgctaatactatgatatccatgatctgttttcctcttttccattaataataatccttcggataccggaacctttttattttccggcatcagaccttttgtatcattatatacgtttgcccctgactaacacaagatattattttcttttagacacttttttaacaatatccagcacttcttgtacagaaaaaaagagactgctcagcactacagtctccttttgcacaaactccggtaggattccccctttattctattgctgccggcaaagccgctgccctgcgattctgttccattttccgcaccagctctgccatgtattcgaaaaactttctctccagatagtttttctctgtgagataactcccatattgatacaaaacattttttaattcttcggtttccgataactccacttcaaaaataaactgccttaacagctgcatgcgctcgtcctctatggaaagaagccagctggcaaccagttctaaaaaatcttcccgctctatgaggaactgcacgtagcgcccaattttattttctgtataaattttcttcttctcctttttcttttgttttcctacccgaatttgtatcaaaaaccaacccccaatgtcagtttctatatgtaatcatatcttattacatatttgatgtaaagacgcgattcgcgtatgctttttacacaaattattactgtataaataatgcattttacacaaaaaaagggcatccaatggatgccctccggtttctatgaactagcactccggctcgatcagaccaaatgtatttccttttctcttgtatacgacattgacctcgtctgtctctgcattgcggaatacgaagaaatcgtgtccggtcagttccatctgcacacatgcatcctccggatacattggcttcataccaaatctcttggtacgcacgatcttgatctcctcatcctcatctgcatcactgtcaataaatgcctcgctgaaattttctgctacattcatcttcttggacgcaagtttggtacgatattttctaagctgacgctcgataacctcctcaaccaagtcgatagatacatacatatcattgctgctctgctctgaacgaatcacatgtcccttaatcggaatcgttacctcaatcttctggcgctccttctccacgcttaatgtaacaaatacattggtatccggtgcgaaaaacttctccaatttggaaagcttctcctctaccgctgccttcagtccctctgtcagttcgatatttcttccggtaattgtaattctcatgatgcccaacccctttgctgtgtatttgatacaagaagtatcatggtttcattatatcataagtaccaaaaaaagcaacgagttttataaaattttatgcatattttatatttttttcatctgttaatggccggtacagttcctcctcatatcgcttgagtgctttctgataaatggaacttggcacaacgtatttatttccaacctcccgaattcttccatctctcagacagcacttcgttccattaataataaattcccggcttgtatccactcccatctcatgcagcatctccaaaaccatcggtgtacattcttcactgatcaaactagaaaaacattgctgatccgcaaaacgcataagtgcgttcatgccataccgcaactgttccattttttcatcatcttcctttgatcttccatacccttctccgtccatacaatcattttttaccgtaatacgatatccatttccaagatcaaacacatctcctaccgcaatattgatactgttatcggttggatcatatgctttcgatgtatgcgtccggtatggctgatgcaaatctgaaaacattttgatttctttatctgtataggtcaccggtctgtatgctgtaaaaacctttgtaccgttgatataaaaatttgaagtcacggtatcttcaatttctgcagtgatttcatactttcctgagtcatccttttgcacatttttcccaatatatccatcacgaaacaaccaaaaaagttcctgcagttcatacttattatttttatcaaatccatttaaatcttcaagcgtttcttctgaagaatcaccattaaaataatctacaaaattattttttgttccatcttttgttgacagctttcccgttgttgcatcatataaatatgtactgctggttccaattccacttacacccattcacctagcccctttcttgaattttatttaaaatgagagttcatttccaggatatggtgccatcacacatccaaatcttccatttaattccgcactccagtatgtaaaatgtgtaccttttgcacaacgccctcctatagtccacaactgtcctaaagatgcacctttaatattttgaataacatcagaatcacctccggctgcactataatatgtttttccgcccgcgctcatatatttttcaacttctaagcatttctttccatctgggaaagtatctttaattgacatattcacaatagcagttatttctggtgttcccccacctatcaaatcaagtccatatgtctgataaccatttgcatataactgggttcccccataagtcttaaaatcgacaatatcaaaatactgaattgatggtcctacatagaaaaaataatgcatattgtcttcccaatcatttccattacagatcctgatataatattttcctgtatcttctgctgtaaagtaaaaatatttttctggttttttttcataaacacttttctgtgatggatcagttgtataataatatccagtcccatcctcattaaaataatataatgaaataaaccaattagttttaccaacatttcttaaatctacaaaatattcctgtccagactgtaattcagtataaaaccaatcttcatcttctttcgaatgcaatcctgcatgtttcatcccaagcgaataaaagtcatttttgcttgttactttcgatgtcacaaccggaacttttgaatatggatacgctgttactatagtatcatttggctcacaatcatctggttccgttgaatatgtagaaattttttctatattaggatatatctccttaacctcatccttatccatatatatcggtgattgttcgtcaaccttaacattttccaaactatttttttgactttctttttcttgtacctgttgtacctccacattttcatattcattactggcaatatccaagctttctttgctttctgccataactggtgtattgaaaagcattactccaactaatgttaacccaatcattttataaattttcatagctttatcctttctttttttctcacacttaatctattagtatcatttttacgcagtcaatatcttacttaatttttaatatacatggccactgaagtaaagctaccaccattatccctgttcctatagtttttgcaatatattccttgccaaatatcgctagtataatctcaaagatttcacatcctattgccagtattgctgtcacctttttatattttgtcttttccgactgatctaatgtatgatctgtggattgaataggactcagtatgcttaaactgatcactgctcccgtttcaaaaataaaaaaaacaaatcttatctgaatatatgaaaacaaaataaaacagccaatcaaaataaccaccgaaaagaaatggcatatccatacctttttcgcatgataaccaccactatacttccgaacaatacttatcgtaattcccaaaaaaactccatttaggaattgtttcataacactccctatcaaaatggctaatataaatggtgcaatagaaaaataaaaactttgcagtgcatatagatacaattttctttcttctaatgaaataaccttttggtaaatcatccattccacaattttattagaaatcatttaaaaattttcttatatttttgcaattcatgtggtttttttacttgatacaacattacagaagactccgtgtttgcttctacacttaatacaatattaagcattttctttaggctctgagctccccacaaagaaatctttttcattttttctcctttcccaagcatatattaactgctatcctcactatatcgtatgacaccaaaaagaaaagcctatatgcacaaacggtcgattttcatacacaagcggtcgatttttgactttttatagactagacttgacttttcattattttaattttatatttatttcaattacataatattaaacaaatgagggaatgtaaaatgaaggaaattgcttacctaatttctcattatatagaggcatttattattttcagtattgtcattgtatatttaaacaaaaaaaatctaattcttctgtgtttttgggatttactttgtgttattcctttttatttggaatttttcattttcagaatatttatgtaaacattattgcctccattcttgctccattgtttttgatcagttatttatatgacgttccaaaaatatatgctttttttcactcgcttgttctttacctgtcaatggcattaggtgaattagccggagcctccctgctctccttactctcagatcattattggaatacatggtcgacagacattcacctgttatttttatcaactatactatgtaaaacattatatctttgcatagtattcatcctgatatgcttccaaaagaaatggcctataaccactcccatttctcccgatcacggttctttttttctagctgctataactttctgttctatgtttgtcagcatcctgttatatatttttggcttacagtttccagaaagttccttaagcaattgcataatttttattacaacagtgttgctcctcgtcatattatttctggtttatgcactctacaactacaacaataaacgcaactctgatctgctgcaattaaaacttcagctgcaaaaagagcaaaatcttgcggaatataacaccgcactgatttcacaggacactgcccgacggacactgatccacgacatccggaatcatctgctttccatttccatcttaaatcagcagaaacgatacaccgaacttgaccaatatatccaggcactcatacactccgaacagttggcaccctccattcgaatcagtgataataacctgctcaacgcaacactgcttcgttatcagacctcctgccacgcaaaaggtatccgatttgaagttgcaattgaaaatcactccattgactttctttcggatactgacctgactgcacttttctgcaatctgcttgataacgcggtaacggctgccgataaagttccttctggatggatttctctccatgtggaacttttttctcccttgcatggcattttgcttaccatgaaaaattcatgtatgaaccgaccaccacaaaattcccggcatgaatggctgacaaccaaaaaagaagtctccacacatggtttcggtatgaaatgtatccgcagaattaccgatacttatcatggagaattacaaactgcttacctcgatgatgaacatatattccaaacgatcataaccatgtatccacagaaagaaacggtgacctatgcgcattctgatttgtgatgataaccctatatttttagatgaatttcaagaactgttaaaagattatttttccaaaaataatctcacacttccatctcctgtatgctatacggatggagactctgtcctttctgataccggagaaattgatatgttgtttttagatatggaactaccaggacatgatggaatctatgtaggtaatatgttaaaaaaaacacacccttataccataattcttgcagtcacttctcatcccgattttcttgatcccgccatgcattttggctgctttgcctatctgacaaaaccaattgaccatgcacggtttttccgaaatatggatgctgccattgtgaaatattatgaacaatcctcccggattaccattcagaccaccaccggatttgttcccgttcaaacccgcgatattatttttgtcgaatcagaaaaacgacactctgttgtacacactttgtatggtatctatcactgtatccagccatttgctttttggcaagatcagctctctcaaccgtacttttatgtcacacaccgaagtatgcttgtaaatttttcccatataaaagaagtgcagaatgaccgtatccttatggacaatggacaatacgcttacataagccgcaggcgaatgacagattttcgaaaaactcttgccgcatattatgccggtatgcatttttcaacatagggcataaaaaaagacgtgcagtgcacgccttttcatcctactgtaaatatccatccttaacgatatctgaaagcttctctgtcggaaccgaaaattctaccagacccatatatcccggagctacctcatacttatcaaagacaaacgttaactctccattgtcgctgatataaaaatccgcatcatccttaatctgcttaaaatcccattccggttgatcatcatccagaaaatatgccttactgctgtcctttttcatctgggcacgcatctgttcttttatactgtcagaaatacgctttttataatcacttccctcgtggaataaatctttcagtgtaatcatctttccggtctttttgtcaatattgtatatctttgtaaaactgtccgaacctcccatggcaataaccgtatccacgcgaagactaaacagccgctcattgtttgtgacaatccggtaatccgaagtgatttcctcatgtccttcctctccgtcactgacagctgccacatctttcttgtacctctgaatgattttgtccagatatccggataccgctgcatttaactcctttgattctcttgtcagtggttttccatctgttccgatgacttttacttccggcaccctgaccgttgcttccatctgctttttttcctgcttatccgaatacgtggtaaaattcacgattttaacaatcgcaccaagtaccggcacctgttccattgcattagccactgttggactgacattgacactgatgaccagcactgcaactgctgccgccactgcttctgccacgcggacaaacggaagcaggtgacctttcttttgattccgttcactttttccggcaaacgcttttccggattcttttttttctccacacgcatcctttttgccgcgttccatgctttgcagcacacgttcttttaattccgccggcacctgaatgttatcatatgcctctttgatatcatctaatctgctcataccatctccgcctccacttttccccttaattttttcaggccgcgataaagcattgatttcaccgtattcggattttcatgcagacaatccgcaatttcgcggattgtccactcttcaaaaactttcagcatgatcaccttacgctctttttcctcgagcgtatcaagcgcagccatgatatccgtgtcctcatagcgatcctcctgtccttcctcctgaacctgatcatcgctcacgaaccttgactgacgccgggttgcatctaccgccgtgttaatcacaatacgccacagccatgttttgatatattttttctctttgatctgactggcatttttcatggctttgtatacgctctcctgcacaacgtccatagcgtcctgctcatttttcacgtatgaaaatgcaagccggtaaagcttttcataagaagccaggatttcctgtttgacagctttacttatatccggatatttcatgctctcttttgcccctttctatttattagacgttcggatgcccaaaaaagtttcacaaacataaaaattgcgcgggaaaaactttctttttgtttttccacacgcaattttgtctctagctttccagctgctcaagctgctgggaaagttcctcccagttttccatatctgccatgatttcttcctccaacgcatcgatttcgccctgaatctctgtcagcttggaatagctggactgatattccggccgcagcagttcctgttttaaagcgtccagcttctcctctttgactgccagttcttcctcggccttcttcacttttttttcaattttcgagcgctccttgcccggattgtaatacgctttcttaccaccggtttcctgtgtgcctttgctctgctgagtgccaccgttctggctgattgcaccgcctaacgctgcaggatttttacgataatcatccccggattctgccgcttcacgatccagtttttcctgatattcctcgtaaccaaactgatacaggtgtgtcgtgccgtcctcaaaaacaagcagacggtttgctaccttgcgcacaaaataccggtcatgcgatacgaaaatgagcgtgcctgaaaaatcttttaacatactctcaagcgtttcttttcccacaatatccatatggttggttggctcatccagcaccaatacattcggtcggcgttttaaaatcttacacaatgccagacgcaccttctccccaccggaaagcatatcaatatttttaaatacatcctccccggtaaacataaaggcgccgagcgcattccgcgcttctgtctcggtcagattcgggaactcatcccagaaatcatccagcaccgtcttccggctcgaatacatcgccatctgctggtcaaaataaccaatctgcacatttgttccaaaattgtactctccggccagcggggcaagctgtcccaccagggtttttaaaagtgtcgatttccccagaccatttccaccgaggattcccagcttttccccttttttcagatcaaaactgaccgtagaaagcggatggtcatatccaatcgcaagatttgtcaccaaaagcacatcgtttccggtttctttatccggctggaaatttgcatggaatgtccgggtatcaaaacgatccggagcttcgagttttaccatatgttcaatggctttctccttggaatgcgccatggacaccttggttggtttatttttaaaccggtcaacaatgcgctgcaatcgtgcaatttctttctgctgcgcattgtaatctttcatcatcttattgtagttttcttttttccgctccatgaaattggagtaattgcccggataacgggtcgctgtgccgtactcaatctcgtacaccacgtccaccacattgtccagaaacatacggtcatgtgataccacgaccacagccttcggataatttttcagatacgtctccagccactcgatcgttgtgatatccaggtggttcgtcggctcatccagaagcagaatatccggcttgctcaaaagcagcttgataaaggcaatctttgtctgctgtccaccggaaaactcggacagcggtttctttcgctcttcctcggaaaagccgaacttacggatgattacatcatactctttttcaaaatagtatccgccgtcttccttgaatttttcttccattgcggtataacgtgtcacggcctcttcggaataatcagtctcaagtgcctgtgccgcagcttccagttcttttttccggcgctccatcggagcaaagactttgcgcacttcctgctccagcgtaacggaaggatcttcaaacgcaatctgttttaagtaaccgatctgcggattgcctgcttttgcaataaaaatatcctcatcactgtctcttttgtccagctccacatccccgtggatcagctttaagagcgtggttttgccgcagccgttccgcccgacgactgcaattttttccgtatttcttatttcaaaattgatgtcatgcagaatctcttcatcggcaaaagagactgctccatggcagatctgatataacatgttttctccttttatttaaatgcatccggctgggaagcaagatagctgacaaactgctctgccgtacgtccggaaatgcctccatgactcaattcccacttgttggcctctgcacggagttgttcatccggtaaggtaacccctgcacgtcttgccagatgcaaaacaatatcaaagtattctttctgtgtcggcttcgagtaattaatggtcacaccaaagcggttcaccagagaaagtttctcttcaaccgtatcggaatggtgacgatcattggaattatcctgatcatttcggtcattccagctctctttgatcagatgccgccggttggaagttgcataaatcagaatattttccggtttggtttccacaccgccctcgataaccgcttttaagaacttatactcaatctcaaattcctcgaaagaaagatcatccatatagatgataaaacgatagtttcggtttttgatctctgcaatgatttcggacagatacttaaactgatgcttgtagatttcaatcatacgcaggccgtctttgtaatactggttgacaatggctttgatactggtagatttaccggtaccactgtcaccaaacagcaatacattgtttgctttctttccctgtacaaacgcttccgtattgtctaccagcttctttttctgaatctcatatccgaccagatcgtccagcataacggtatccatattgttgattgcacggaatgtaaagcttccctgcggtgtatcatcaatccggaatgctttgttgagaccaaacattccaacaccgtagtctttataaaaaccagtcactgcatcaaagaattctttttcatcctttgccgcctccagttttttgcttaaagagcggactttttcgctgacatttttgttgtacatcagatcctttttatggatggccttataattggaaatctggctgaaacagttgattcccagatctttttcgattggtccgaaatcatagtcaaacaactctttaaaaatacggaaatcattttccaccagttcattgacacttccatcgctggctcccaccttttcacaggtcatgctgaaaggattttcactcatcataaggaaaaatgtcagataattatgccacagattatcatcaaatccataatctgttgccacttttaaaatccgttttacctgcgtattgatatcgcggacaagtccggttttattatattcaccggtctcatatttcccgaatacttctcccatctgtgcaaggattgaatcctcgtccaaatctccatacatcagtaactgtgatatttcctgatacattgtatctcgcctctttcttttctcttcctatttattttacctatattacacgaaaaaggggactttgtaaaccaaagtcccctgtatgcagctaaaaagctactgtgatcgttgttccttttcccggctcactttccaaatgaagtaccgcatcatgcagttccacaatatgcttgacgatagcaagtcccagtcccgtaccaccggtctgtttggatctgcttttatcaacacggtaaaaccgctcaaaaatacgttcctgctggtcttttggaatcccgataccattgtctgctacagaaagcatcggctgtcctttttcatagtacacacgcacgtgcacctcaccaccttcattattatagcggatcgcattctgacacagattttccacaagttccgaaatcatgcccctgtctgcccgcaacatgcaggacacgccttcataatacagcgttacattccgtttctgtgcattcatctgcagatttttcacacaggtaccggctacctcatccagatctacctgttcaaaacacagcagattatcttcaccgctgtccagctcggaaagccggatgatatcattgataagagaaagcagccgtgtcgcattctgctggatttccaatgcaaagcgggtctcctgctccggatctaccatatggttttcgatcagctccgcatatccggaaattgcagtaagcggtgtcttcagttcatgggaaacatttgccgtgaaatcctgacgtacttttgctgccatcaggatattttcatgctgtttacgaatcgtatttacaaatggcacaagttctttgtatacaggttcttctatggtatcttccatgttttcagcaagccgttcaatcggatgcagcaattgtttggtcaaaaaatgtgccaggacaatacagatggaaacaatcagtatcagtatcagcatcacaaatggggatgccgcaaggaacacactgtagacactgcgtgcctgtgttgccacacggataaccgttccattttccagccggagcgcataatagtaattgtccatctgcatggtatccgaccgccggacactttctccctccccctgaaacaacgccttctttacttccgggcggtttttgtggtttggaagctgtgaaatatccagatcattatcaaaaagtaccgtaccatcctttgcaatccaggtaacacgcaggtcttccccgacttcataatattcggaaagtgaaacatttgtattgtccggatcatcaaacaatcccgtgccggaaagcagtcttgcattgatctgcagatccttgcgcacctgtccctgaaacagtttataataaataccggtcatacagaccatggttacaatcactgcaatacctgcaatcagaatcagccgtaaattgattcgtttcttcataacagctccttactctatcacatatcccacatttcgaacggtacggattttgcttcccgcttctccaagcttctgccgcagtgtcttgatatgcatatcaacggtacgggattccccttcaaattccgttccccacacatgacgcataatcacctctctggacaatacaacactcggattggtcatcagcagacgaagcagttcatattccttaaacgtcagttccaccggcttatcatccacaaaaaccatgtggcgctcatgatccagtgtaatgttttctacctgcaggactttaatatcctcggtttctgtcctccgtaacagtgcctttactcttgtaataagttccataatggaaaaaggcttcttaatataatcatctgccccttcgtccagacctttgatcatatccatttctgcggtctttgccgtcaccataatgaccggcaatttctttgtcgcaggatttttccgcagtttacgcacgatatcatacccactctcatccggaagcataacatccaaaagcaccagatccggcataatatcctccagttttttataaaatgtagttgccttttcaaatgcgcagaccatgtaattgctgtttttcaatgcaattgtctcaatctccctgatattttcatcatcttctacgatataaatcaatgccataacttttccctctgtctatctttatatatacctctgcaacatcaagcaggacggccatgcctgcacaagaccgccctctcacacgtattctatctgtttcttatcatagcatacgacatgtaaaatccaaagtatcgtttatgtaaaatttatgtaaagttctatccactgtcaggattcttttatttcttttttatcattcaatgcaaagataacccattctgcaatattagtcgcgtggtctccgattcgttcaaaatattttgcaaccatcagcatatccgccgcctgctcgcctttttccggatcatgccggatcagttcaatgatatctgccttatttttatcaaacaggtcatctacaatatcatcatgcctgatgacttcctgtgccttattcatatccttttccacatatgcttcgatgctgcggatcaacataattacggtttcactcgccatctttttgatgtcatccagattcagcacatacggttcttttgaaagcatgattgtgatttccgagatatctgctgcatggtctccgattcgttccatatccgttaccatcttcatggctgcggaaatcacacgcagatcccttgcaaccggttgttgctgcatcagcagattaaaacagatgttttcaattttcttctgttcatgatccacatcagaatctgaattcatgattttttctgcaagctgcgcattctgagctatcaatgcttctattgctttctggatggaatcctcgatcatggttcccatatacatcatttcctgattgagcagtctaagctgctcgtcgaactttgagcgcattaaccaaacctccctgtaatataatcttctgtccgtttatccttcggataagaaaaaattgttttcgtatcgccaaactcaaccatttcccctacaaggaaaaatgccgtatcatccgatacacgcactgcctgctgcatattatgggtaacaacaactaccgtgtatttctttttcagatcctccatcagttcttcaatctttgatgtggaaatcgggtccagtgcagatgtcggctcatccatcaacagaacctcaggctgtacggcaagtgcacgggcaatacagatacgctgctgctgtccaccagaaagacccagagcggatttctttaaacgatccttgacctcatcaaaaatagctgctccgcgcagactttcttcaacgatggcatccagttttgacttatctttcattccatgtacacgcggaccatatgcaatgttgtcataaatactcatcggaaacgggttcggctgctgaaacaccatgccaattcttttccgaagaacggttgtatctacgccttccgcatagatatcctcatcatccagtttcacttctcctgtgattctcacgccatccaccagatcattcatccggtttaatgtttttaagaatgttgattttccacatccggacggtccgataaaagcggtcacgcaattctcacgaatattcatgtttacatccttgagtgcatggttttcaccgtaatacaggttcagatcacggacagtaatttttgttcgtttttccatgtttctctcctcatctgcaatggttttctctcactgcaattatccatttcttaggatttatgaatattataaagagagattgtaaaatgcactggactgggaatgtaaaatttttgcaaaatcaatgtaatggatgtaaagtttcttgatacgccaaatttgcaggttgatgttttaaatataagatttctctaagtgacgtaagaaggggggacatttcttcctgttggttggagaaaatataattgaaagacatcccaataaattaattgatgataaggcccggtatctatagatgaaaaattaaagcctaaggtgacgttttctcgaaattttaatgctagaaatctggacatgtcacctatatagtaaaaattgcttctccggataccgcttttttcataaaagtggtacctgaagaagcaatttttgatctatagagactttccggtatctaaatatttaattttcggtatataggtaccacaacggtatcttttacatgaattttattggcatagagaccacgccgatatctttccgatgaatttaccggtccatcttttccacaaacataagcagaaaactgatcagaagcagtccgctcgatacccagatcatatgatatccaaaccggatagagagatttcctccaataccagccccgagtccgaaaaataaaataatgccaaaataatacagtgccttttttaatttttctgtgtcatgggtctgcagataaccggtaaatgcttctgttccgctacgaagatttccgatgcacattgtgcttgcataagaatatccgcttactttccggaacgtctgtacctgcattgcacatgcaaacgataccagcacggtagccagcagatccaggtgttttggcatgaatccaacaaaaaacagaatcacaatttccatcaaaagcacaccctgccgccagtgcagtttcttagcatatttaaagatcacatgaatcttctctgcaaagaaaacacccgatgcaaatgccagaagcggtaataagtatcgtaacacatccagccattctcccatcatcaggtgcgtactcatcaaaacaatatttcccgtctgtgcgttggaaaatacttcctcacgcgtaaagtatgtatacgcatcctgaaaacctccggacagtgccaaaaacacacttgtgacaaatgcttccgacatttggacgtccgcatttgtcttaggatttcctagtttcatcacttcacatccttctttttaatatataaactctatatattatagtgtgcttttatacaaaattcaacctaaattataagaatgaccgcatatgaatgcttaattcttcttcctgttttatcaatttctttgcaatatcctttgtttcctcatctgcagcctgatactggttcagataacggcttaaagattttactcccatgttacagccgtccgttatcagatctgcgatcgttgcatccgattcatccatggcaagttttacatttgttttcatccaggacattccctgtgccatcggatttggatcttttcccgtatcgtgacattgttcgagtttattctgaatttcttctttcagtttttcatgcccttctttacatgtttccagcagtttttttaatttttcattggtggttttttcgaggacctccccgatggatgccgttcccatcttgattcccgcgtcgcattctctcaataattttatagtatccggttccgtcatttcttcctcctttatgaaattgttttattacggtttccgtaatgattgtcattcataagtattcccggattttctgttaaatattttcaggcaccttttcttcctttattattttctaagaaacccgtaaaacagccattgactgatttcacagagaaatttataatccaagaaaaaagcaattacaaagatggcttccctgcagcagacacttaataccctggattataaatgctggtattacgaaaccgcattaaaagccggcaccaccgatgtactgcaaaacatgcctatagaagatattccggaacagtttcaggaggtgcggcagaacctgacgcatgttcccatgcctaccagcgcatagcttttcaaaaatacgcaaaaatccttcggaagcgaccttccaaaggatttctttatatatatttatctgcggttgacatcaaatttctttgccagcgctttggtaagcaggttaatgccaagaacaatcatcagcagaaccactgcaataccgaatgccactccgaattcacccttggtcgcgctcaggtaaagctgaatggtaagagttccggccggcattttcgcctttgtaaacagatcggcaaagctcttcgggaggagacccgagcttcccgccgtaaacaacagggctgctgactcaccgacaattcgtccgatggcaagaataacaccggtgatgattcccggcatcgctgacggcagtaaaatagtccttatcatatgccactttccggctcccagaccgatggcaccgctgcggtaactgtccggaactgtttttaatgcttcctgtgtattacgtgtaatcagtggaagcaccatcagcgtcagggtaaaggaacccgtcaggatcgaatacttcaaatgaagtgtctgcccgaaaaacatcataccaaacagaccaaagataatggacggaatacctgccagcgtctcggttgcgaactcaatcatgctgaccagttttcccggttttgcgtattcattcagataaaccgctgcaccaacaccgatgggggtagcaatcagcatggttacaattatgatataaagcgtatttacaatatttcccgcaataccggttgttccttttaacaccgaagtgacactggtaaggaattcccagttgacgctccggatacctttgacaaatacatacacaatgattccgagaagcagcgcaacggaaagaattgcacacacatagatggcaacataagtaaagaaatccgccggatgtctggttttcgtacgaatacttgtattacttcctgtcatttttcaacggctcctttcttctcgacctgcgcaagcaccagattgatgatcataataaagataaacagtaccaatcctaccgtaaagagcacttcccggtgaagtccttccgcataactcatctcactgacaatctgtgtggtcaggaaacgtaccgagttgaatggaagcggcagatttaccgaacctccggcaaccatattgattgccatggcttctccgagcgcacggccgataccaagaaccacacctgtcataataccggatcttgctgccggaatcataactttaaatattgtctggatatgtgttgctccgagggcaagcgaagcggattttaaatgtcccggtaccgcacggatggaggaaacactgatattgattaccgtaggcaaaatcatgattgccagtacaataatcgcagaaagcagattggaaccaccggtaaactgatgggttgtacttcctgcaaataccctcttttccagacgatacatcagtggatttaaaaccataagtccaagcagtccatatattacagacggaattgctgccagcagctctaccgccggctgtacaatcgctgccagctttttattggaaacctctgtgataaataccgctgtcagaattccaatcggtacaccgatcagaattgccactgcagtacctacaatagaagtcagaataatgtacaaaataccataagatggtgttgctgctgtcggctgccatacagttccaaataacaggtcaatcaccccgacctttgccagtgccggggtgccctttgcaaacatataaaccgttatggaaagaactgctacgatggcaacggctgcgcatataagaaatattacttttgcaatcgtttccacgatgtgctttgttgctttgccgcctgtcatatctttatcctcgtttgcctgtttacgtgtttcttaatttacattatttgctgtttgggatgatcagtcctacagacttgataacattctgtccgtctgcagagttgataaagtcgaaatatgcctgtacctgcttgctctgctcagaaatctcacccttggtagccattacgaacggtctctgtaatacatagtctcctgcaagaatattgtcttctgtcggctctacagagttgatctttaatccatttacggtgtcatccagcacatccagggatacatatccaactgctcccggagttgctgcaacctttgccaaaacagcacctgtagaatcaagttcctgtgcatatttgcaggaatcctttacatccatcagttcctcaaatgcatctcttgtaccagatcctgcctcacggccgatgactacaatctgctcatctggtccgccgagatctttccagtttgtaatctctccagtatatacttttgcaagatcttcagacttaatatctgtgattgtgtttgctgtatctgtaataactgcgataccatcaattgccacaatgttctctacgataccctggcttttctcatcgtcagaaagggcacgggaagcatctccgatatcaacgctgccggctgtaagagactcgattcctgcactggaccctgtaaactctgcggttgcggaaacgttcggatatttctccatgaatgcttcgttcatggcatttgcaagtttctccatggaagtacttcctgccagtgtaacggttccactcagatccgctccatctgttgtatctgcatttgcagttgtatcagatgccgttgtatctgtatttgcatcagcacttgcatcactgctgtcagaaccacatcccatcacacctgcagcgaccattgttgttgctgtcagtaaagccatcatttttacaagtttgtttttcatgattttctcctctttctttcatgttgttcctcattacagttgttatcttatcgggtctgtgtaaaatgcataaccagactaatgtaaattcaatgtaaaaaatatgttgtcctgtaaaacggcaaaacttacgaatgttttaagtttatttaaggttcccgtcttatcttctatgtataaagatgttaccgtagtctacgccattgtaaccgcacacaaagggaaaatttctgccaaaagtgaagatggaaattccctgactttttccattcttctcaattaaacatcccatgtttccacaaaaaagagaagaagattcttacatagcatgcagaatcttcttctctttttcattggatctttataagttatttcaaaaatccgaaattgctgactatagcagcttcctttgcctttccattgcagacgttaacaaaactgatgatacggacaaccagtaaaatgataaaacatacggctgctgcaatcggaacgacaacggtccagcagaacactacggtaatcagtcccagcagaacttcagacacaaggatcctgattccctcacgcacatgaaatccgacataaggagaatccttcgccacaagaagtgccacgatggttcccaaaattcccagaagatatggaagcattgcaaacagtttgtgatctgcaatatcctttccgtcaaattctgcggaatgatcctttggatctacataaggctgcccgtacggcatcccattgttcatctgtggattgccataatacgctccgttgtttccctgtggatttccgtagccgtatggcgtcccctgcggatttccctgctgtggtcctccctgcgaattctgattttcctgtgttcctgtatgtaagctggctccacatctggtgcagaacgcactgtcatccggcatttcactgccgcacttcggacatatcatataaaattcctcctcttcgtttgaaatgaactctgcgaacatctccgcgctttttattttatataagtttatgttgcaagtcaatttagattctcttaagttttcattttctttcttcataaattgttttcagaatacctgtgtgccttttaaagttcatttaaagttcccccgctatactgatcctatcaaaataaaggagaaccatcatgagtgatcaaatgatctttaaacgatacaaaatgaaatatctgctcaaccgtacacagtaccggcagataacagaagtctttgagggccggatgaaaccggatatccacgaaaaaaacaccatttgtaatcagttgtccaaagctcaccagcggagaaacgtacacgctccttgccggtgataccaccacaactgttacattggattcccttgtaaaatcggtaaaaaaataaagtgtgcgtttaccgcacactttcgcgcccttgcggagacacagcatcatctttgactccgcagggcgcgcatctttgcaggctgacctgctttaattgccaagttccagcatggtatcaatacagcgttttgcttttatacgcacttcttcgtccagcttgatttcctctccgccggtgccctttacacactggtacacatctccgagtgtggtcagtttcatattgtggcagacacagtctcttgataatggataaaactgcttgtccggacatgcaaactgcagatgctgcacgatactgttctcggttccgataatgaattcctttgcatcacttttctttgcatagtccatgattccggttgtacttccccgataatccgccagttcggaaacctctggcagacattccggatgtaccagaagaagtgcgtccggatgtgccttttgtgctttttccacatcccgtttcgacatgcggacatgcgttggacatcccccctgcagcagtttgatatttttctccggcacctgatcagccacccattttcccagattgcagtccgggataaacaaaatatttttattctctatattctttacaatctgaactgccgatgaggaagttacacagacatcacaaatcgtttttaactcggaagtcgtattaatatacgctaccacggtataatccggatacatctttttcaccccggaaatcagttccacatccatctgctctgccatcggacatcccgcattgctgttggataacaatacccttttctgtggggacagaatcttgaccgtctctgccataaaacggactccgcacatcagcacagtgctctgcgctgccttggcagcctgcacgctcagcccataggaatcccctacataatcagccacctcccagatatcatgactctgatatgcatgtgccagaatacagatatccttttctttcttcaggcggatgatctcgtcctgcagttctcttgtcgttaacataaaatactccttttcacgaaatacccttctatacagacatttcttgttacattcaacatattacatagagtatactcacatgcccgtcaggtgtcaagacacaaaagggttaaaaccacggaagcctgtgaaacgggatgataaggatttccttcgacttcatgtcatccgttgtaatgtaggtatgtttccaatatcgcgcatccagggaaatttcccggttatcccccaacatgaaataagagccctccggaacggtaaaggttttatcttcttctccacaatccgtttcgacagtgtcatccagataagccgattcatccagcggttccccattgatgtatacttttcctccgacaaaagaaaccgtctcccccggaagtccgatcacacgtttgaccatggtttcattttcatctttctgataaaacatgacaatatcgccgcgttgtggtttttcttcctcatatgcatgacggtctccgatgagccagtcatgaaccatcagtgtcggttccatactctcagatggcacccgcccgatcatcaaaaaacaacggaatgtgataataatggcaagaagaactgctatgtaaatcacccaccccacgatatcttttcgtttttgttttgtctgttcgtccatagattcctccctgtatgtttttcatttggaattaatcatatcataccagaggcaaagatgtataaatttttttaagattgtaagtaacgtgaaaaatttatgcaattactgtaaatctctgtggatattttcggttgtgagaaccccggtgtttatgttaagatgggggtgtctgttatagaaaggagaaacagatttcgaaaagttaaaaactttagcgccatgtaccctgtgatatgtaccacaagggttaacgaggattcaggtgatcgaagattcggcggatgcctgaacgcaggaatggggctgcgcatacgaatcacaaacaggatggtaacatccgaacaaaggattcgtaccccgatggagccaattgcatgagaatttgcttacgcgaagcaattggcatatgtgataacacttacgtgttaccacataatgcacaatgaaaaatattctgatgaacgaaaacaatatcgggatcataaaattatatgagaaaaaggagatttcaattatgtgtggaattattggatttacaggtaaattaaaagcccaggatgtcttattgacaggacttgcaagccttgagtaccgtggatatgacagtgcgggaattgcgtactttaaagataccggaaaaatttcacttcggaaaactgtcggaaaagtaaaagatcttcgtgccatctgcgatgatgataacaattctacgtgtggaatcggccacacccgctgggcaacccatggtggcgttaccaatgccaatgcacaccctcataaggtcggacaggttgcattgatccacaatggtatcatcgagaactatcatgatctcgccaccaaatacgatctgacggatgaactgatttccgagacggataccgaagttgccgccgcattgatcaataaactctacgaaggagatccaaaagaagctctgcgcaaagcagtagccgaaattgaaggttcctttgccttctgcgttctgttcaaggatcatccaggtgaaatttatgcggtaagaaatgtcagccctatggttgcaacatactgtaatgacggtgcttttattgcatccgatctgactgcttttatcgcatacaacaagcgttatttcatcgtgccggaatatcatattttaactatgactgcggacggcattacgttagaagatttagacggtcattccgtagaaccggaatatatggaagtaaactgggatgttaccgcagcccagaaagatggttatccgcatttcatgatcaaagaaattcatgaacagccggctgccatcacaagaaccattaccccacgtatcaaagatatgctcccggatttttcggaagatgccattgcggattccttctttgaaaatgtaagcgacattacaatcgttgcctgtggtactgcaatgtacgcgggaatggtaggaaaaaccatgatccagaaccgcctgcatattccggttaccgtggcaatcgcatcggagttccgctatgaagaaccggtaatcaatgaaaaatccatggtgatcgttgtatcccagtccggagaaaccattgatactttggaagctcttcgccttgcaaataaatatacaaagaaaacactgtctattgtaaatgtaaaaggctccagcattgcacgtgaaagcagctatgtattatatacacatgccggtccggaaatcgctgttgcaagtacaaaagcatacaccgttcaggttgcttctttttacctgcttgcatgcaaacttgccatgaaacagcaaaagatttctgtcgaagaagcacgtacatttattggaacactgcaggaaattccaaattacatcgaggaagttcttgcacaggctcctgatattgaacagctgaccaaacgcatgatcaatgccaacaacgcgttctttatcggccgtggactcgattataccctttgcatggaaggtgctttgaaattaaaggaaatttcttatattcatgccgaagcctatgctgccggtgaattaaaacacggaaccattgctctggtcagtgaaggggttcctgtcattgccgctgctacccagaaacatgtatacagcaaagttatttccaatatccgggaagtaaaagcccgtggtgcttatgtcattcttttgtccaaagacaaagaaatcacagatccttctatctgtgatgtacacatcaatcttccggatgtatccgacgaatttacgatttttgaatctgttgtaattttccagctgattgcatattacacatccgttggaaaaggcttaaatccggatcagccacgtaacctggcaaaatctgtaacggtagaataagaaaaaactgtcgcgcgaaaattcgtgcgacagtttttttgacatagagcctttctaaaacttttgaaggcaaaaaaagaaccccagaagcttactaaaagcctctgaggttgcccctgccaaggattctctcacccatgtaccggaatccttgtatcgtcggcgcgacaggatttgaacctgcgacctctgcgtcccgaacgcagcgctctaccaagctgagccacgcgccgtttcaactgcccaattatagtaacacattctccggtgtttgtctagtgaatttttttaatttatggtacaatacaaaaaaagaatggagaagaacaatgaaacatactgctttgattacaggtgcatcccgtggaatcggtgcagccctggcatgtcgatttgccgctgaaggctatcatctggctctttgctgccataactcttatgaaacgctgcaggcacttgccacaaaacttgaaacaacctactccatacaggtgctttgcttccgtggtgatgtaggagactatacttttatctgtgacatggtgcaaaaaacactggataccttcggccagattgatgtgttaatcaacaatgccggcatctcttatatcggtctgctcaccgacatggatattaccgactggaaccggattattgcgacaaacctcacatccgtcttttccacctgcagacaggtcatcccctccatggttcatgccaaatccggacatatcatcaatatttcttctgtatggggaaatgtcggagcttcctgcgaagttgcctattctgcatgcaaaggcgggatcaattcccttacacgcgctttgggcaaagaacttgcccctagcaatatccaggtaaatgccatcgcctgtggggtaatcgatacggatatgaaccgttgtttctccgaggaagaacgctctgcactcatcgaagaaattcctgccggccgtatgggatccccggaagaagttgcttcactggcatattctcttgccacagcaagcagttacctgaatggacagattctcaccttagacggtggatggatttaatttcttatctctttggaaatctttttccatttatttaagaattaaaacgcaatacgcgttttctctgttttttatatcaactttctataaaatcatttgtatgaaaacgaatgataaaaataaatacaaagattttggtgaccgtctgagtctgattatgtataaacaaaatatttccaatatccagctggcaaatgcaatgtttgtttcgccgtccacgatcagcggataccgtaccggtcgtcgttctccgaccgttgcggatcttgcagccatcgtgcagattctgaatgtttctgcagattacctcatcggaaccagtgaaattacaaccagacccgataccaccgaaaaaaagagttgagcacgccctgtttccagagcggtgctcaactcttttttataaatcatgttctgccagtaaaattaccgtagaacgttccggaacacgcacacgtgtctgatctccctgtgtctgggcttcaaaatctgccccatcctggtattcacagaaagtatttactacaagtttccaatgataagactccggcaacgaaggcaggcgcatctccaaaggctcccaatacgcattcattccgtaaaagatcatatcatcatccgtatcatcggcatttcttcccgcatacatgattccaattaaatgtgtattatagtccgtataattccggttcggctctccgttatggatacttacggaaggtaacccgcagactgccggctttgtatcccttcgcagaatcggatgctttgcacggaaatggatcataaaacgggcaaaatcatgaatctcctgaaattcttccagtctgttccagtccagccaggaaataatattatcctggcagtatgcgttgttatttccatactgcgtattacaaaattcatcccctgcaaaaaacatagccggtccacggctgcataacaacgcggcaaatgcattcttcacgagtctgcgtcgcaggctcataaccgccggatcatccgtctcaccttccaccccgcagttccagctcaggccgttgttatccccgtccgtattgttccatccgtttttctcattatgcttttcattatatgaatacagatcatacaacgtgaacccatcatgacaggtcagaaaattgacggatgcactatatccgcggcttgccggatcatacatgtcggaggatccggtgatacgtgtaattgcacgccctgcgacgccactgtcgccctttaaaaagcttctcatatcatcacggtatcttccgttccattcggcccagcggttccatgacggaaaacttccaacctgatacaagccacccgcatcccaggcttctgcgatcagcttcatatcccccagaatagagtcaaatgcaagggcttccagaatcggcggattctccatcggtgcaccattctgatctcttcccagaatcgatgccagatcaaaccggaatccatccacacggtactctactgcccagtgccgcagacaatccgtaataaacctccgaaccaccggatggttgcagtttaagacattgccacagccgctgaaattataataatatccatccggtgtaagcatataataaatattgttatcaatccccttaaagcaaaaacatggaccgtcttcatttccctctgccgtatggttgaataccacatcaagaatgacttcaattccattttctttcagttcgcggatcagacgctttaattcatcaccctcatgattatgctcctgatgaaatgcataacttgtattcggggcaaaaaaggaaaccgtattatagccccagtaattgtacaactgcacgccatccaccacacgggcactttccatttcatcaaattcaaaaatcggcatgagttctaccgcattgattcccagatctttcaaatacggaattttctgtcgcagaccttcaaatgttcccccaccttttacaccggaggacgcatctttggtaaatcccctgacatgcatctcatagatcaccagatcttcaaatttgtaattcagattccgataccgcccccagtcaaaatcactttgcaccacacgggctttatagacaaaatcctttccgccttccggtttttctccccagtttctctgaccggtaacagctttcgcatatggatcaagaagcgtatgttttctgttaaacagtaaccctctcgcctgatcggcaggaccgtccatctgataggcatactcaaaatcctctgcttttaagccaaaaacaaggatagaatacgtatttccaattttataactttccggaatgcggattcttgcatacggttcctgtgccgccggccggaataacagcaggacacaactcgtggcaccatgggagcttacggtaaaacttaccccttcctctgtctgatatgcaccattcatctgataaaatcccggacgtacatcaaatccaccgatattatcgagtggatgaatgacttccccgagactttccatttcttcgtctatcggccagcttttctgttttgacggataattccaaaaacttgcattcatgtgctgattcctcttatcattattatttacttgccacataaaattatattatccccctactcttccctgatgattaccctgccatttgcgtcaaatccgattttactgtacttttccgaatactcattcatatgatcaataatcgtctgttttctgtcgccttttgctatggcaggctgaaaattatttctttctgatgtggaagaaatgctgcatggtatcatatcggctgatatatctgtctgcagtaccccatccacaaaggtaaaggtctgttcatagatcgccgtatctttgtcttttggattcctgttccccccaaagcagaaatttccaagactgtagcagatcatttttccgttgtataattccattccctgcaatacatgaggatgtgtaccgaccagcagatctgctccccagtcaatcacctggtgtgccagcttctgctgataatcattcggataatgatccccctctatcccccagtggcaacaggcaattaccagatccgctccttcttcccgaagttctgcaatcccatcccggatataattggcatgtgtttcatcagcggacagctggcttgcggagacaattccgattttgataccatccttcgtggtataggtatccacatgatcattgaatccgaagataatccctgctttatttaacacttctctggtatcatcaagtccctgctgcccataatcaaacgtatgattatttcccagacttgccccctccacagaactgtctgtcataataccaacatactccggttttccttttaagttccacgttttttccacacgctcggtcgcatttgacaacacacattccagattgatcagtgtaaaatcatcctgctcaaaaatacttctgatatttttaaaaaaataatcctgcccgtatttatcatagtattcatgaaaggaacctgcatacccatgcgtctgtgttgccccaagcgtacagtcacctgtcgccgtaatttttaccgtctgtatcactggttcctgctgcgtttcagttgcagtcccggtttccgtttcttccagcgtacccggttcttccgtcatctgtgtctccgtgattttttccgtagaagagggcaaagccgatgacgttgctgcaggagaagaacatcccgtcagcaaaaatcctgccattaggattggcaatatccattttttcatacgttttcagactcctctttcacaagaatatccaccgtgtgaccgcttgcacccataagatccatccgttcacaggttgccagatgatactgcagaaacgcatcaaactcttcttccgtcagcgcatttaaaaacggacgcatataatttgctgcaccgtctgccgctatgatctgccggcgcctgacctctacctgccggtccaatgcttcaatatcttccagacgaaccatggaatacagaggattggcttttgaagtacagtgataatcctctgtgagcattccctcctgaagcgcctccagaatatgtttttccttaaacgcatacgtgataacggaaaattcattcataatatacgccacgagaatcctgcctccgggttttgtcaccctcactgcctcccgcagcgcagcaagcttgtccttttcctcatgcagatgatacatcggcccaaacaacagggttacgtcaaaggaatcatcggaaaattttttcagattcattgcatttccctgatatgcatgcacgcctgcccccttctgtttcagacgccccagattatgctttaccagttccacggccgtcacatcgaacccttcctgtgccagcggtacgctgtatcgtccggttcccgccccgatatcaaggatatgaatttcctcttttgcacgttcttttacaatttcgtccagacactgatggatataatgcatgcttgtcacaaattccaccctgccgtgtcggctgtccagacgcttctcttcattaaatttattataataggcttctaagtctgtcatattttaatactaacacattttctttaaaatttcactcacaatcgctgatgcgacatccgctttgctcattatttccagttccctgcagtcatctgccgtaatcagcgtcaccacattggtatctgtaccaaatccggctccggctactttcaggttattcgccacaatcatatctgcattcttttttgcaagttttgcacgggaattctccagcatatgttccgtctccatggaaaatccacacagaaactgtcccggttttttgtgcgcgcccagatacgaaaggatatcttccgtgcgttccatcgtaagagtggcatccccgtcttttttcttgactttctcatcgaccgggtgatccggacggtaatccgccacagctgccgctttgataataatatcctgttgctctgctgtctcctttacggctgctgccatatccgcggcagatacaaccggaacgacctttacaaacggcggcggagtgattgccaccggtcccgtgatcagcgtcacttccgcgccacggcgcatgcagttttccgcaattgcatagcccatttttccggtagagtgattcgtaatataacgcactggatcaatcttctcctgtgtcggtcctgctgtgaccattactttttttccgaccatatccttttcacaggcaagatctttcataatataagaaaacagtgtttccggctccggcattttcccggctccggtatccccgcaggcaagataaccactcgccggatcaatgatatgaaacccataatgctccagctttttgatgttatcctgtacgatcggattttcaaacatattggtattcatggcaggggaaacgtacttcgggcattttgccgcaagaatcgttgttgtcagcatatcatctgcgattccgtttgccatcttgccgatcacattagcagaagccggcgccaccataaaaatatctgcacgctttgccagtgccacatgctcgacattgaactggaaattccggtcaaatgtatcgaccagacacttgttgcttgtgagcgtctcaaacgtgataggattaataaaattggttgcattttccgtcatgatcacatgcacatccgcatgctgcttgacgagcgcacttgccagacaggcgattttataggcagcgatacttccggtcacaccgagtaccacacattttccttttaacattgtctcttactcctttgcagaaaaaatcatatcttctgctattttatcacacttgcgacagaatcgtaaagaaactgtcttcaaagttaacaacgttcaaaattcagatatcgggttccctgaaatgtcagttttccaacatccccttctgcaagcattccatattcagatccgcgcacattcatttccatgcgatctccactctccacctcaaacgtaacataataagttgtgtttgtatgtaccatagttgtatctgtcccatcattgaaatgcgttatattcgtccgtttggctacaacctttgcctctactgtcagtctcggtgcatgattattgtcattccattgtgaaattccctttatgattgtaaccacaataaaacctgctacaacaataaacataatcggaaaaattacatccatcacattaaaaaacatacttttcccctcctttaataaactcataccttttttattttagcatacccctgttgaatgcactattgctttttccaaagaatacaacaaaaaaggcagccctcagatgaatatcacgaaattgatattcgtcttcccgctgcctttcaaaatcattatttctggatcggttttaatttattcagtaccatgccaagcgctgctacaatgattgcagccacaatcgcttcaatgactccgttaaaactgatgacaccaccgatgattccaagcacggctcctgcatcgacactcagggcttttgcatatgcatctttgtataacacaaaaattccgcccataaccagtatcgtattgaccattgcgcctgttacacccgcgtagacaaatgcacagactgcgccggatttcagtaccgtatacacttccaatgctataaaaacgaaccatccaaccagtgcacttactgcatacaatgcaatatctgacaatggcttcttgtcaaacacatgaagcagaaacgcacgcgcaccaagaaacaggaacacaccgatcagaatattaaacacacttgcccagagaattttgtgccgggaagaaagtgctttctttactccgatatatacaaaatatggcagaattcctacaagaatacgcggtacaaaacagataaatacactctttacgattccgctggtgcctaccatgctggctgccagtaccggggaaaatacaaatgccgaaagggatgtcggcataaccgtattcttgataaagctggtcagaccaaagataaatcctaaaaatccacccttcttcggtccacagaataacgatcctaaaatgacagggatgtggatgatggtcgcattgatcaccacaagcgggatgtagcccagcggtgtaaacgccataatgataatgattgctgcaaacagagcggtcagtaccagctccgcggtcttattgtttcgcattggttcctcctgttccagatgaaagcggatgttatgttttccgtctctctctttttcttttgcgaataaattaaacattaactttatcagtttacaccctgctcctcttatggtcaagtcatacgcatcgtgaactcctaatctccaaaaacataatttttcattgaaaaaatatcgctaaggcgatataatattttatattatcaggaggaaactatgggaacaatactatatcacggttctgaatatttaatcgaaaatcctcagttcggaaaaggctcgttgcacaacgattacggcagagggttttactgcactgaaaacatcgaattagcaaaagaatgggcctgtggaaaacaaacgaacggctatgccaatatttatgaattggacatgtctgatcttaaatgtttaaatctcaatagtaaagaatacaatatcctcaactggcttgcgattctcgcagacaaccgaacctattggcaaaacggaagcattgccgaggaggccaaaaaatatattaaggatcattttctacttgatatttccggatatgatgtaattattggttatcgcgcagacgattcctatttttcttttgcacaggattttgtttcaggtctgatatcgtttcaaaaattatcggaagccatgcgtcttggaaaattaggtgagcagatcgtcctgaaaagtgaaaaggcttttcagcagcttaaatttatcggatatgaagttgctgacgcagaagaatattacatcaaaaaaaccgagcgggaacgcgaagcccgaaaagagtaccgtagaaacaaaaaaggaaatgccaatataaatgatttatttatgcttgatatcatgagggagggaatacaaaatggagatgcgcgcttatccatctgattatcttacatctgcccaacgcattttaggcgatatgcttgattttgccgtcaatacctgtgacctggacattgattcatattttgggcttttcacggtatcttctgtatccgtgcaatttcaaaacggaaatccaacctatattgctggaaaaacaggctgtgaattagttaaagaagtgattgcagatgcaggaatgtccccactctcttacgaagatgaaatgtatcttgataaatctccggaatattgggcaggctgggctttagcatattatcaatggtacacctgtcggacttttaccaaaattcataaagccgtttctttaaagcgaatcgtttccatgtacgacatttatcacgagatggatattacacattttatcgataccatcaacgaattatgggataattattacaaagaaaccaacctcaaacgactccggaaattagctggtttgtcccaacgcgaattatccgaattatccggggttccgttacggcaaatccagcttttcgaacaacggcaacgtaatatcaaccataccaaagccattgatgtcgtaaaatttgcacgtgtcttacgctgcaaaacagaagacctgttacaaatatagtaaaaccgccgcggaaatccgcggcggtctcttttcacacttatataaaatgaaattatttgcacatctcagcctttaaaacaactcatgcatcaatcaaataaagaatattctttttctgcccccacatttgatactacacataacaatgccccataatttggagtaacatttttgttaatggcaagaaaacacgtttcgccttcacctatataatacacatcgcttacgctgtaatattctgcggtctccacccccatcggttctgttttcggattccagctttcttttttatctaattgattcttttgttgttttgttttcaaatcatactgcaactgtttttcattatcacttagctggatataccgtccatccttcgatacatgaataaatgttgcatcatctccctgtaatcccttaaaatgatttttttcaaaatcaacataatccgtcaggtctgaagaggaaagatcataaacatacacccccatattgtcataaacaactaattgtccctttccgacataaccaattttaggcattgtatcatcaaaatttaaagttgatttgtaacttgccagccttgcaagttctttcgaatcaacattattcaaaccaatttttttataaagaaaacttccaaataatactactaataacaatccactggcaacaactatatatattgttttttggcagctatattctttcccaatatttttaatccgcatcttcaatgtactcctttcgcaaataaaaggtcgcatagctgatacatattttaatctacctttatcacataaccgaagtaatgttctggcataaaattttctttcctccattgatgtattttgtaatgtctgttcatcacaggccatttctatatctttatttactccaaaataaattaaccaacataagggattataccaatttaaagcaagagctatataatacaacatcatcaatagataatctttgcgttttatatgggtcttttcatgctgtaacactatctgccgttgctctggactcaaatcaaatggcaaaaatattttgggtttaactaagccgataacacaagccatgctttctttccactcatagatttcatcctgtgaagatatcttctttgcattctttgttcttctacaaacagcaatcctctgtataatataatatacagcaaaaaccaaaagacctatataccacaatatcataagaatatttatattcttcttttttcccatgtatggtttcgatgtattttcatcttttggaaatatttgcaaagaatcatcacttttcatttcctgtgcagaaagattttcattcttttcaacaaatgtttccgaatacaaaatgccatattccgtatatatagataccggaaacaataaacgtatcaaaagtatcacccacaacattatttttatgtgattagactgttttctcaataaaaatcttataaacaaaaatagtataataactattattgttccactcaaagaaccactataaaatttaaaaaaatcattcatgtagttcctccttatattcgtctattactttctccaattcttgaatatcttctcttgtcagatttctttctttgataaacgaaaggacaaattgcggtaatgaatttgaaaaatattcctttataacttcttttctctgaccattttcataatctgctcttgattttaatacagtaataactgcctctgaattacaaaccatttttttatcaactaattttttcaaattagtataggttgttgactttttccaattaaaccgctctaaacattctttaacaagtttatttgaaggaatttgacccttctcccaaattacttccatcaattttaattctgcttttgtcaaataagttttcatttctatcaccgtatttattattttacctatttatttttggtctaaactacttagactacttttagtctaagtcatttaaacctgtttgtcaagtatttcctcacacaaaaaaaccgccgcggaaatccgcggcggtttcttttcacatctttatgtaagatgaaattatttattcttcatttcagcctttaaagcctctgtcagagctggaacgatcttgttcagatctccaacgataccgtaatcagctacggagaagattggagcatcctcatccttgttgattgcgatgatcaggtcagactcttccataccagctacgtgctggattgctccggaaataccgattgcaaagtagatctgtggacgaacggtcttaccagtctgtcctacctgataatcctgtgctaaccagccgttttctacagcggcacgggaacagcttaccattccaccgaatacatcggcaagatcctgcagcatcttgaagttctctttgcttccaactccacggccaccagatacaagaacctttgcatccatgatgttctctacgtttccaactgccttaacaacgttaaggatgtcaacgtaacggttgttcttctcaagtgtaggattaaactcgatcacttctgccttgcgaccagcctcttttggaagcttctgcataacaccaggacgaacggtagccatctgaggacggttgtccgggcaggcgattgttgcgattgtgtttccaccgaatgcaggacgggtcatcagtaactggttgtgcttctgctcgtcttccttaccaggaactgcgttgattgggaaatcaccgatctcaagctttgtacagtcagcggtaagtccagttgcaactcttgcagatacggtaggaccaaggtcacgaccgattgctgttgcaccaactaacataatctctggcttgtactcattgatgactgctgcaagagcctgtgcatatggctctgtacggtatgtctcaagttcagggttgtccactacgataaccttgtctgcgccatactcgcctaactcatctgttaagccctttacgtttgatccaagaaggactgctgttacgtctgttcctaaatcttttgcaagctcctttgcctttccgattaactcaaaagcgatagagctaagttcattgtctacctgctgtgcgtagataaatacgcccttatattcttctaaacccatgttattcaccacttttctctataatcttagataatatgtttctctttgaattttccgattaagtatgcaacggactctgcaggatccagatttactttctctcctgcacccttcggtaccttatcagatgccttagcgatctttgttggagatcctttcagaccaaggttagaatcatctacatcctttaagtctgctctgccccatacggtaacttctttgtcacatgcatcgaaaattccacccggagtcatatatcttggctcgtttaactcagaaagagcagtgatcaggcaaggcattttagccttaacttcatgatatctgtcctcatactgacgcttaacgattacggaatctccctcaaccttgatatcctcagcataagagattaccggaagtccaagatgctcagcgatctgtggtcctacctgtgcggtatcaccatcgatagcctgacgtcctgtgataatcagatcataatctaagttacgaagtgcaccggcgattgttgtggaagtagcccatgtatcagctccacctaatactctgtcggtaacaagaatagcatcgtcagctcccatagccatagcctcacgaagaacagcatctgcctttggaagtcccatggtaagaacagtaacctttgcaccgttctgatccttaattctaagtgccgcctcaagaccagctttgtcatctgggttcatgatagcaagcattgcagctctatcgagtgttccgtctgcgttgaactttacgccgccctttgtatccggaacctgtttaatacatactacgatattcatgtattatttatctccttttcttcaatcttgttgtgacgcaactgtacgattatcttaataatgatccagaaataaccatacgctgaacttcggaagttccttcgtagatctctgtgatcttggcatcgcgcatcatacgctctacgtcgtactcacggatatatccgtatccaccgaataactggacaacttctgttgtaacagccatagcggtctctgctgcgaataatttagccttggcagcttctacagaataaaccttctgtgtagccttagccatggcagccttgtaaacaagaagctgagcagcttcgattcttgcagccatatcagcaagcttgaactgtgtattctgctgctgtgcgatagaacgaccgaactgctttctctcttttgtatatgcgatacaacgatccaaagcaccttctgcaataccaagtgcctgggcagcgataccgatacgtccaccatcgagtgtgtgcattgcgattgggaaacctcttccttcctgaccgagtaatgcatcctttggaattctgcaatcctcgaagatcagctcgtatgtagaagatccacggatacccatcttcttttcctttgtaccgaaggagaatccaggagcacccttctctacgataaatgcggagaagtttttcttctttcttcctctcttgtcctcggtaatgcttgtgattgcgattacgatgtaaacatctgcaaccttaccgtttgtgatgaaacacttagatccgtttaaaacccactcatcaccatctaatacagcctttgtctggcagccctgtgcgtctgtaccagcgcctggctcagtaagaccgaaagcaccgagcttctcgccctttgcaagcggtactacatatttctttttctgttcttcggtaccgaatgtcatgattggatcgatacaaagggaagtatgtgcagatacgataacaccggtagttgcacaaactttggataactcctcaacgcatgtaacgtatgtcagaggatcacatccctgtccgccgtactcctttggaaccggaattcccatgaatccgtattttgccatctttgcaacagtttcagccgggaactgctctgtctcatctgtctcctgtgcaagaggttttacttctgtctcagcgaagtctctgaaaagaccgcgagccatctcatgtttcttgtctaaagtaaaatccatgattttaacactccttaattatgatttatttttatttatacttttctactgtgcgtctacaggtgtctttgtgcggtctgcattgtagatgtagaatcccttaccagacttagcaccaaggttaccaccacgaaccatcttacggatgagtgggcatgcacggtacttgctgtcacctgtctcattgtaaagtacatccatgattgcaaggcagatatcaagaccaatgaaatcacctaactctaaaggtcccattggatggttagcgccaagcttcatagctgcgtcgataccagcgatatcggaaacaccttccatcttgatgaaagcagcttcgttgatcattgggattaagatacggtttactacgaaaccagcagcctcatttacctgtaccggggtctttccgatctctacagcgatcttcttgattgcttcaacagtctcagcaggagtatttacaccagcgataacttctactaacttcatacggtcagcaggattgaagaaatgcataccgatcattggacgtgtaagtccgtttccgatctctgtgatagaaagagaagaagtattggaagcgaagatacactctggcttggcaatcttgtctaactcagcaaatgtagtcttctttacattcatatcctcgaaagcagcctcaacgatcaggtcgcagtccttgcagaggtcttcttttaaacctggagtgatcttggcaagaatgccgtcaaccttctcctgtgtcattttctcttttgcaacaagtcttgcatatccttttgcaatcttgtcttttccgccttcagcccactcctgcttgatatcacagagtgctacttcatatccgtcaacctgtgcgaatgctttagcgattccctgacccattgtaccagcaccgataactccaaccttcattttagttcctcctaaataataaatatattcacatttcaaggggatgcagcgcaccccctctatgtatcttatctggcaaaaaaattagtatttctcaacgattgtagaacatcccattccaccaccgatgcaaagtgtagcaagacctctgttagatccacgcttctgcatctcatgaagcagtgtaacaaggatacggcatccagaagctcctaccggatgaccaagtgcgattgcaccaccgtttacgtttaccttgctcatatcgaactttaagtctcttgcaactgcgatagactgggcagcaaatgcctcgttagcctcgatcagatcgaaatcatcgatagaaagaccggtctttgcaagaactttctttgtagaagcaaccggtcctacacccatgattgcaggatcaactccaccgagtgctccagccacccatgtagccataggcttaacaccaagttccttagccttctcttcactcataacaacgattgctgctgcaccatcgttgattccggaagcattaccagctgtaaccagtccgccttccttacctgagcagcaacgtaacttggaaagagtctcgactgttgttcctggacgaggtccctcatcctttacgaaatcaaccatttccttcttaacctttacaggtaccggaacgatctcgtcatcaaacttgcctgctgcgacagctgcctcgcacttctgctggctgtttgcagagaactcatcaagttcttctcttgtaataccatacttgtcacatacgttctcagcggtgatcatcatgtggtagtggttgaatgcatctgttaatgcatcgttaaccattgtatcgataattgttgcattgttcattctgtatccgaaacgagcctttgtcatagcgtaaggagccatagacatgttctccataccaccggctacaacgatatcagcctcaccagccatgatcattgttgcagcatcgtttacacacttaagaccggatccacaaacaacgttgattgtgattgccggaacttcaatcggtaaaccagccttgatggaagcctgacgagctacgttctgtccctgagctgcctggattacacaacccatcttaacttcgtcaaccatctccggcttaacacctgctctgtttaaagcttctttaattacaattgcacctaaatctgctgctggagtattgcttaatgctccacccatcttgccgattgctgtacggcaagcacctgctaatacaactttctttgccattcttcgttctcctttaaatcaaactcgcacccaatgatgctgttaattttttaacaatgtctataataccacattttccgcacaaaatcaatgaaaacctacgttgttcataaaaaattcttcatttattgcaaccggctctgtttcatggtatatttatggtatatttcaagcaatactgaggggaatccaaacgggggatcatgtgatatgaaatttgtaagaacagaagacttaaaggcaggcatgcgtcttgccaaaccaatttacaataaaaaaggtgtgctgctttatgagcgcaattccgcactcaccgcgccgggaattgccagtgcaaaaaatttcggcctgatcggtgtctacattctcgagccggccgaaccgcttcctccgctttcccgtgaagatctggagtttgagcagttacagacggtatacattttccgtctccgggaagtgttaaactgcattaccgagcgcagaaaactcgaaaaatacccagtatttctggaagatattctttcccactacgggtctttaaaacaccgtgtgaattttaaccagaatctgcgcagcagtgatgatttcatgtacaagcatgcgatcagcaccgcaatacttgtaaccatgatgggcgcccatctgagactaccgaaggaaaaactccgtatactgaccacggctgcccttctttatgacaatggataccggaatgttccgcggaatattctggaaaaaggaatgaacgagctgtcctcatccgatcaggatgtcatccagctttctctggaaaaaggacttatcccgctttccatgtaccggaatgattttgactttttcccacgcgcactggctctgatgcagacctatgtatatgaagaccacctggaaaaactcgcaaccgctccggatcaagaattacaggaaatggcatccattctgcgcatcgccgactggtttgaccggatgactgccatgaacagcggacatgaaccgatgtcagaaattgccgtcatgcagtatttcaaaaaatacccaaagaagtttcttccggtgcttgtcacagcacttgcagagtgtattcatattgttccaaaggccgccagtgttgatctttccacaggtgataaaggcattgttcttatagaaaacacccgtgattttatgcgtccggttgtcctgcgcctttctgacaatcagatctacgacctgagcgacaaaaacgtttatcaggaaatgcaggtgaccgacatcatgaaaaccatggataaccgtgttgccatggatgaagaaaccctaaagcaatttgtaccggatgaaaagctccgacaattaacgcaggaattccgcagaaaacttgctgccgggaaaaaatagcataaccgtaatcaccttggggctgtgaaaaaagaatagtcccgaaaaaagaaagaccaagagtttataatgaactcaaggtctttctttctgttataattaacttgcaatgaaaattaataacataatctattctaacccaaaacaggcagttttgccaatactaattcaagattatctggacatctgtgatccggtgctgacatttgacagatttatgggagaaatcgaactggagaaatatctgaaaaatattccgcaacatgatacaggaagactcagatatgacccggtcagcatgctgaagacagttttgtttggatttatggcaaatggctatatatcattacgtgagctggaggatcagtgtaaagtcaatctccgcttcatgtatctcatggatcatcaaacaccttcttaccgtaccttcggctactttataaacgaggtacttgctgattccatagaagaaatatttcaggacataaacaaaaaaatcttcgagacagaacacgtggatctccaacacctatacattgatggctccaagtttgaagcaaatgcgaataaatactcctgggtatggaaaaaatcaacagaaaaatccagataccgtctatttgataagatcaccacactctttgaggaaatcaataaggaactggaatgtacgggtataaagttttgtatcaatagcgagtatgcgccagagtatctgaaagaagctgctgaacagtatgcagaagtctggcagattgatgaaacgatgtttgttcatggcaggggacatcgcaaaactacgcagcaacgtcattatgagaaactcagggagtatactgccaagctggaagaatatgtagaaaaaatcaggatctgtggagaagatcgtaatagctactcaaaaacagatcattcagctacttttatgcgaatcaagacagactacatgggaaatgaccagctgcttccagcttataatgtacaggttggtgttgcagatgaatacattgctgttgttgatgtaaatcagtaccgttccgatatggactgttttattccactaatgaacaagtttcagaatatatatggtttctatccaaagtatccagtcgcagatgccggatatggttcttacaacaattacatcttctgtgagcagcatggaatggaaaaatatatgaagttccccatgttcaagaaagaaactactgacaagaagtatcatgaagatccatttcgtgcagtaaatttcccaatcggggaggacggaatcatgcgttgtccaaacgggaaaagcttttatcttcagtatcgtaaaaatgtaaagggaaacaagtatggacgacaggaagaagtatatcagtgtgaagattgttccggctgtccatatgcagaacaatgtaaaaagacagataaaaaccgtaccgttcggctcaaccatgaacttacatcgatgcatcaggaagtgattgaaaatctcgaaagtatcaagggagcgcttctaaggatgaacagatccattcaggccgaaggtacatttggtatcataaaaaacgaccgttggtataaaagaattgtccgaagagggataaaatctgtattgcttgaagtatttcttgtttctattggacacaatctttataaatatcacaataaacagaaaaaagtcgcaactgccgcataggattccataatagcattcttatggggaaagggggagtatacacttttttataaaatataactactgttgtatctataagcaaaaggacgcatgaaaaaactttcgttttttcacacgccctttttttatttttcacttgacgcgtttcctctattctgttatatttacttcatcaggcgtagtacatctatcgtagcaacgacagacgaaatacgacagataaagtaaggaggaatgcatatggcaatcagcagtgatgttatccgtggttacaatgacaccatgattctttatcttctgctggatcagccatcctatggttatgaaatctccagacagatcaaaacgctctcccatgaaaaatatattatcaaggagaccacgctctattctgcgtttacacgtatggagaaaaatggctatatcacatcttttcaggatcagaacactgcaaccggcaaacgccgtacctactaccggatcaccggcaaagggcgtgcttactatcaggaaaaatgtgaggaatggctgcttacgcaggaagttgtagaacagtttatcaggaaaggggaaacagaaaatggaagctattagaaattatctggaaactatgtttttaaatcttccaaacacgccagaagtatacaaagccaaaaacgagctctggcagatgatggaagacaaatacaccgagttaaaaaatgagggaaaatcggaaaatgaagcggttggcaccgtcatcgcggaatttggaaatctcgacgaacttgcagaagatcttgggatcaaacagtttgttcaccagccgcgacaggagcagactcccaatgctgtatcgctctctatggaagatgtcagacagtttctgcgggaacattcccgtcattcctactttgtggcactaagcgtatttttgtttatcctttctgcctgctgcccgatctttttcggggctgctgcagatacttcgctgcgcagcagtgatgtacttgatgcatccggtgttattctgatgtttgttttcatagccatcggtgtgggcatgcttgtctattcgaatgtatgcatggggcactggaaacacttagaggaaggaaattttgttactgattttgccaccacagactacatccatcatgaaatggaacattataaaagcacacatgcgctcctgctgaccataggtatcatgctgtgcatcttaagtgttgtcccaccgatccttttagatgcggcatccagttttgctgcagatacacttgaggactgttccgccgggtttgtattaatctttgttgccatcggcgttttcctacttgtaatcagttccatgcgcatgggtggatatcgcactctgctgcatctgaacaaccagaacaccattggcggaaactacgttccggagcagcaggaccgccagcagtaccataattccacactggctgcaatcatgtccgtctactggccaaccatcacctgcctttacctgatctggagttttctttcgttcgactggtggattacctggattgtctggccgattgctgcgattgtagaatccctgatcaaaaatatcagcaaaaactaatgggaggagaactgtcatgaaacgaaatgtttatttaatccttattaccgtcattacaattctctgtatcattgcaggaaccggctaccatctggtgcgttttggcctctccgtggcagagggactgccgtccttcagtgaatttatagaggccatctctgactgggatgatgatggtgatgacaatgatgatagcgatgacaatgatgatagcgataatggtatatccacatccgtagatgccagccaaaaaaatctggatgccttctcatccatcaatgctgacttaaatgttgtcgatttaaccatccagcgggggaacactttttccatcacctgcaaagccagcaaaaagcttaccccggaatataaagtagaaaacaactgcctgacaatcacacagtatgccaaagcccacaatgctctcggcagaaacaaaaaatgctctgtaaccatcacggtcgccgatactttaaccgatttaaaactccatacaaacgtgggcgatgttgacctgtccggtctgaacgttctggcacttgacctgcgtgccgatgtcggagatattgatctggagaactgcactctggagacttccacactggatgcaaatgtgggcgatattgatctggaagattgtacctttacttccatggaaattaccagtaatgtgggagatgtcgatctcgattgcaaggaagacctgtccggttaccatatagaattaggaaccggtgtcggagatgtaaatgttaatgatacctactgtcaccgcagttactccaaccaaggcgattcctcacactcgctgaccatttccaacgataccggggatatcagcttaacctactgattcccaaaaagagcggaacacctgacggtgcccgctctttctttttcattatcttttattttaatgtaagaaacagatttgctttcttgagtgccggacgaagtgccatgtagataattactgcaacaacggcagaaatgatggcattgacagaagtcgttgtaatattccataccagtgccacttctgcagccggttttcccatcagcacacgcttgtaaaaatatccgaacagtggatcaaataccacattaaagccaagtccgcagaccgtggcaataattgtccactttaatacatgcttattgtcatttgatgtagagatatgaccaatcttgtgtgcaatcagtcctgtgatcagaccgatacaaaatttcaaaataaatgtctttggcgcatacacaacataaactggattaaacagatctccgattgtcataccgatcgctccgccgattccaccgtatacaccgccaacaagcagtgcacccagcacacagacagcattgccaagatgaaacgaagttgcatctccacccggcagggtaatctgaatttgaagaaatgtaaaaatcacataggataatgctgccatcagcgcagtcaatgtcaatttgtaaatattttcgtgtttcataaccaattcctcttttctgtaaaatctaacgatattttacagcagaatggttatatgtaaatatccagttttatatatttttatagggccagacaatgtctgaccctatttttaatttccgcactctattgaaatttcattaaaggttcctagaatatcatcgacctgcatcgccttcttttcggctcccgccttgtcaatgatcgcatgtccctgatgcatcatcagaagacggtccccgtattccacggcataacgaaggttatgagtgaccataatcgtcgtgacctttttctcttttacaatttttccggtgagctgcatcacaatctcggcggtctttggatcaagtgctgcggtatgttcgtccagaatgagaaattcaatcggtttcatcgttgccataagaagtgccagcgtctgtctctgtcctccggagagtgccccgacctttgtatgcattttatcttccagtcccagaccaacacttgcaagaagctcacggtacgcattgattcttgcatgattcgttccgcgtcccaaaccatacgtttttcctttattgtctgctatagccagattctccagaatcgtcatggacgggcaggttcccttcgatgggtcctgaaatacccgtccaatactctggtggcggataaaatcttttttctttgtaatatccacgccgtttaccataatcttaccaccgtccaccggaatacttccacagatgatattaagcatggaagtctttccggaaccgttacttccgacaacagaaacaaactgtccgtcctcgatggtcaggttaaaatcatcaaacaggcagatctcattgatcgtgccgggattatacattttgtgaatgtgctgtaactccagcatttacgccaccttctttctctttttgcgatccatgccaagtacaaggatcacaaggaataacactgccgtaatcagtttcaaatcagaggacggcataccaagccggatggcaattgccacacaggctttgtacacaatcgagccgatcacgacgctcgtcgtcacacgaataaatgtcaccttttttaacagactgataccgatgataacgctcgcaagaccaatcaccatcgttccggttcccatcgaaatatcaaaataccgctgctgctgtgcaaaaatacatccgcttaatgtcaccagaccgtttgcaatcgcaaggccaatgattttgattacacctttgtccacgcccatagatgtcacgatcgtttcgttatcaccaaccgcacgaagcagataaccggacttggtattcatataccagtccagtaaaaatttcatgatcagtgtaataatcaggataataatggtattggcaaatggtgccagcgcaccggaaaataccttctttaccaatgcattatcaaacaacgttgtcatattataaatcggaaggtttgcgcgtcctgcaatccgaagatttaccgtataaagagctgtcatcataataataccggacagcagatcccggacttttaattttacatgaatcagtccggttaaagtacctgccacagcacctgccgcaaatgcgatcaccagtgtcagaaccggattcatccctttggagatcagcaccgcagaaagtgccgccccaagaggaaaactcccatctaccgtaagatccgggaaatccagaatcgtatacgtgatataaatgccgagggccataatcgcatagatcataccctgctccaaaacgcttaatactaatgtcatgtcatacccctttataactttataacttactctactgtaatctcatcaaatgtctgtgcagcatctttgatgtaggattcgtccagcttcatgccaattttatcagcggctgctgtattgacgtacagctctgcttttgatgctgtaatgtatggagtatccgaagccttttcttctccctttaagatctttgctgccatctttccggtttcaattccaagctgataataatcaattcccatggatgcaacacatccggattttacctgctcgatctcgcttccaaataccgggatctttgcactgtttgccttatcaagaaccgtctgtaacgcatttactaccgtattatcggtcaggttacacagacaatctaccttgccaaccagatccgttgctgcaatctcaatatctgcggaggtattgatacccgtgtcaacaatctcaaagttataattgcctgccagctttttgtattcttcgatggtgctgcaggaatttgcctcacttgtggtataaagaatgccgatcttctttgcatccggaagcatcgcacggatcattttcagctgttcctccaccggaaggatatcagaagatcctgtgatatttccaatgctggaaccatcttcgtttgccaggccggcagaaaccggatcagacactgcagtataaacaaccggaatgtccgtattcatggtagagttgtatgcgctggctgcacaaggtgttgcaattgcacagatcagatcatcctttgcagatacaaagctgtcagcaatcgtgcttgccgtaccggtatcggtctgtgcattctgataatccaccgtcaggtttttgccttcctcaatgccttcttcttttaatccttccagaaatccttcgcggcagttatccaaagatccatgctccgcaaactgggaaattcccactttataaccactctctgtcgctgcattctgtgttcctgtagctgcatttccactgtttccgcatcctgccataagtcccattgcacatacggctgtcaaaaccattgctaatactttctttttcataatcttttcctcgctttctttttctgactaactaacttcagaaacaaacctttcccggcttttctgactctgaaaatcaaaaaaccgtctcaggaaataaatcctgagacggtaataaagcctttgctttcttatcgcggtaccactcaaattgacagtcatctgcccgctctgtcacataccttcatatgcgccgaattggtaacgggttcggttcccggcgacacctactcaataaaccatatcaaaaatatgtttcctgcattaatcgcctccgcataacggaatccatgcgatctgctccttttcaggtcgccctcaaaagtccattcaacaaatccttccatactgcatcgcaccacctgcagctctctgggatatccagataagtctactcctctttctcatcggtttgttctcttattgctatactttaatccttttatctgtatttgtcaaccgctaaatctggaagaatttcagatctcccgccagactgtctgccatctcatttaactcttttgctttttcgaccagctgctcgatcgtctgattcagttccgtcatggaagcggttgtttcctctgtagatgccgcattttcctcggaaatggaagacagacttacaattacttcttctaccttattgcgggcatcatcgcagatacctgtgctggacttgatatgcgcagtctcttcactggacttttggattccatctccgagtgtacggaaatgttcctgtgtacttgcaagtttttcctgctggttctgcatgatctccgtcacttcgtctacaatgctgacggtctgttctgcttcatttgccagttcttcaataattccgttgataatatctgccgaagaacttgactgctctgcaagcttctgaatctcacttgcaactaccgcaaatccctttcctgcctctccggctcttgctgcctcaatgcttgcattcagggaaagcaggttggtctggcttgcaatggaagtaatcagttccgtcgcttcacggatcttctgcaccgattcatttgtggtatgtgtctgctgtgccacctgcgcaaaagcttccgttgtacgactgttggcacttccgagttcctccataaactgtgtggattccacacttacctgctgcatctgctcagccatctctccaagctggtctacatctgctacgatctccgcaaaaacatctcccatttttgaaatctgtgtcgatgctacatctacctcactggcctgattggtcgctccctttgaaatttcctctaccgcgcttccgatttctccggatgtcatattactgttctttgccattacatccagttcgtttccggatttctttacgtgcttggaaattttctgtgcggatttgatcacctcagaaagtctttccaggaactgattgacatacgcaccaaacgctgagaactcatccttgccgtttgctgcggcacgaacggtcaggtttccttctgtcatctgctgcaatgtatttttaaagtttttgatactctcattcatggttcggctgatcagcagtgtcagcataatcagaatacctgcacttaaaaacagcacaaaaatcataattgctgtcagtctcgttctggatgcactggtatctttttccacttctttctgtactgtggctgttgtctttgtcaaattatctgccagcgtaatattttcttttttcagcttcagaacctgctcgtccaccttgttcatttcttcaaactgagactgcttgtctgccagcttgctgctcacatcactctgctgtcccttatcaaaaatatacagtggaatattatctgtcatctctttgaactgggcttccagtgctttggcttcatccgccacatcatttccttccataacatgtttgctgtatgtcgcaaaattatcgttgatggaagcaaatgttccgctgaaatcatatttgtccgaaaacgctgcagcaagagacaattccgcatagtttcccttttcgagataagcttcaaacgtaacggtactgtaatcctgcatcgcgtaggaagtaatcggaagcttaatcgatacttcttcccactttgcattggatgccgtaaacttactgttgaaataaattgcttttcctttattaaaatcagtgattttctgatcttttaatgcatcaccgtaagaaccggaaatatcctcatccgttactttggaaagatctattttttcttttttactgcctttttgaaaactgatgttactaaaatatacttttcccgcatatcctgcaccgttaccaccgattctggcaacgagataatctctctttccgccttccggaatttttcccttataaacaaactttgtatatgtttttccgtcaattttgattgtctgtccaccgccgctgatggatgaccagctgccatccagccaggactgatcatctttgacagcagcaaatgtatttgcaagatcctcatcattggcaatgaatttctgatattctcccacatccgaagtgtaacctctctgtgatgccagttcacggatctgtgaataattatccttgcactctccgatggtttctgccaccgtatccagtttcttcttctccagaatggaggcagattttttggccgccttgctgtcattttccatatcggataaattctttacaattttttcgaggtaggaatcatccagaaagtaaagataagaagtttccagactctgattctcactctgtgccacattaatggcattaatttcttttaatacctcattgttccggctgttcttatttaacgcggtaattccgccacttcccaaaatcacagatgctgcaattgcaactccgcccattaaaaggatttttcctttaatgctctgtacgagtctcatcttcatattctgtactcctccttcattcttctctggtactttccatttattttctaataaattttatcattaaaaatacttaatttcaatattttatcaacttaaatttagctaatatttcgcattgttttttggtgattttttcttttattactttatatccatacaaaaaagacgtcttttgcagacaaagcccacaaaaaacgtctttttcctttttatcgccagattccccggcgtctgcgaatcgtatcatacatatcgtgttccattgccataactttttccaccggaacacttttaaaaaccggcatcttcattttaaaccgaatccagaagaaggaatatacacccagtgcaaaaaatactgcagcagataaaaatagaatcgcattgcgttccaccgggtctgttgaaatgttacaaatcataaaaatagtacccgcaattccgataagcggaagcaccggtccaaacggaaccttaaaacttctcggagctttcggaagacggtgccgcagcaccagcacatcaatatgtgcaaaaatataggacaccatccagaataccgatccaaccagaataaaaaaggaaattgcatctgatgaatcactgctgataaatgcaaatacaagaatcagaatactgatgaaccacacaccgacatacggcacattgtttttgttcagttttttaaagcagcgcggcatcatattcatttttgccattccctgacagatacttgccagcccgttgatcgcagagttctgggaactgatcagtgccagcgccgccacaaaagccatccatatttttccgacatttcccaaaagattttctccgtacagcagatgcggggctgcagaatctgccagcttgtcccatggggtataattgtgaaatccaaacaccagaaccgactgcacgatacagatcaatcccagcccgagaaacataccgagcggtacattacgcctggcatttttgacatccttcgaaatcggaatcacatattctgcaccaataaacagccagaatgcaactgcggtcatggaaacaatcgttttccagtctgcggaaagaaccatcggctgactcaccttttttcctgtgccaagtcccagcatgccgatgacacccataatcaccattgatccgaccatcagatatgccactgcatcctgaatctttgcaaacatatccacaccctttaaattggcaatcagaagaatgaccgtcaccagaacggtataggaaaagtttggaatcggcagatgaaaaatttctcccatggcatatgcaaaaattgaggcttccacaccggaagacaatacattgcagaacagataccctcccaccatggaaatcatcgtcggaaacggtcccaggcaggcaagcgtatactgtgccagtcccccggtcgtattcggcatcagggcattgagttccgacagggatgcaatggttgtcatgttaaacagacaggcaattaccatggcaaaaataaaggtcacgccaatcgtccctgcgccctgtccgagtgaaaccagacaactcgttgcaatgacaagtcctacagaaacagaaataacacttttgagtcctaacttcttttcttccataaacagaccccccatcccctacaacgctttttcgccctcatcaccggtgcggacgcggatgacattatccagtttatagataaagatctttccatctccgatgtgaccggtatacagctgttccttgatgatctctacgatggaattcacacgctccgtttccacaacaatattgatctgctgttttggaagcagttccatctcttcaagctcatccacttcatactctctggttcctttttccacaccgcatccaagtacctgcatcacggtcattccccgcacaccggctttgctgagtgctgcttttaagctggaaaattttgacatgcctgtaattacttcaattcttgacaaactcatggtctttcctccttggtataatgctctttacaattccagttcgggaatctttgttcctgtaatgagccgctcataaccctgtggggtaatcccggcatactgtttaaaatctttgatcatatgtgcttcgtcataatagccgcactgctgcgccagtgcatccagccggatcctctccggcattttatttatgacatgcagcagcttctgaaaccggacaaaccgttcaaaattctttggcgaaattccatgcacctgctgaaaaacacgccggatataacattccgaatatccggtttcctctgccagctgccggatacaaatgcatccatcggtatcataaattctctccctgagataattttccagcttttgtatgccatccgccagttcttttccacgcagttttgcatattccgtcgtaaatacattgacacgctccgaaatatttttactcccggcaagtttttcggtcaggtgatctccaaacagattgccatcaatctcgagatctttgttaaccagatcccggatggaaagttcttccggcagaatacagctccccggctgaaaacgaaccccaaaatatgagcgtccatcctcaaactcccagccttttgctgcaagaaccgttcctccaatatacgtcttgacatcctgctctccgattccaaacaacaggtccacactgccatccggcaccgctttcatctctacctttgaatttttctttttggaaaattcataaaaatgggagattccggatttcatttctttttttacctcataatcatctgtatccagcaccagatacggctgcattggcatgacgtttttcattttctttcgccccttgtacttaaacctctgccagggccgcccggcaaaaagtacttaaaaaggcgtaccttttatgccatatccggctgatcccataaaggcagttccacgccgataccttcttttaatgcattgcggtatacggtaccgccccaggcaatgtcctcaacaggcataccgcctaccgagtatacaatgatctcatcatcgctctcccgtcccggatgctttttattaatgatatcggcaatatctacaatatcttcccgctgaatccgtccttcgtgcagataatccgtaaacttggaacctatgatctgtaccatctcataactcggatacggaaattcctctgcccaggcttcatacagtttatagttatccaccactttcttgcagcggttgatcagaaaatcatcatcaaaccgtgcagccgatggcagacagatgagtgcaccttttttgacccagtcttctgcgatatatgggaaatcgatttcttttaccggtgcggtggaagtaacacagatgatgtcactgtcttttacggcctcttccatcgaatcacatacgatgacctgctgaatctgcggacattccttctttacgaactcttcaaatgcatgcagggaacgctgtcctcttcctttcacttttaccgtagtaatcttcgggcagacacttaaaaaagccagcagacaggttcttcccataacacccggtccgataatggtaaccgtttcggaatcttttcttgccagatattttgccccgactcccggaattgctccggtacggtaacagctgacaagatttgcagacatcagtgccagtggcgccccggtatctttatcgttcaacatcatcatcagaatggaacgcggcagaccggaagctttattctcacagttacttccataccacttcattccggccatcctgtattttcctccaagatatgccggcatcgccataaaccggcggtcgtctgcatttttcggcattccctcaaactgcggatcatctggaaaaatgacctgtgcaccgtgggaattatggttgactccggccatcacataatcgcctttgttcaatgtaaccagcagatcttccattgcctccacacactgatccatgttctttactccggctttgatcatatccggttcactcaaatataaaaatttaatcctggtatccatatgcatttcctccttatgttttcagaggtatggaatatcaaagcaaataaacaaaaaagacgccatagtatcacctactatagcgcctttgctacttattcgtgcttataatataccatactatctttttgattgctactcttgtattcttttttatacaacgatcctgctatcttagatcactgcctgaaaccggtcataccgcagttcatgcagatccagtgtggtttcttttcccatggccagttcggataacagttttccgacaatcggtgaaattccaaatccgtgtccggtaaaagcacaggctaacagcagtcccggcacttctttaactggtccgagtaccggtactccgtccgcacacagatcttcatatccggcccaggtacggacaatctttgcatcggcaagttttggaatgtatttcataattccccggcagatgcacggagcagtgatacttgaagtaatcatatgtccattgtcacgattttctgcctcaaatccggaagcacctccgaatacaaaagatccatgattcgtctgatggccgtagaaatccgcatctgcggtaccaagcatctgtggaaacatctttggctctgcctccgtaaccagtgcctctatcagctctttgcgcatcgggatgtcaatgccgacactcgctgcaatcggacggctttcatatccggatgccagtacaatgttttctccttcatacacatttttttctgttactacacgtctggcttttcctttgatcttctggatctcgagcacatcctcacctgtaataaactctgcgccaagctctctggctctcttgtaaaaaccgagggttgcaacgagcggattggcatgtccgtcggtcggacaccagctggcaaccgtaatctcatcgcttaagtatgggttgatctcacgcacttcttttccatcgatcatccgcacatccagtcccagtgcaacggcacggtccgtcagtccctgtaagatttctttgtgctttgctgtctttccgagacgaaggtttccttctttatggtattccacatccacaccgagttcttcggacagtgtcggccacatgtgttccacggcatacatggcaagcggaagttctctcggatcacgtccggactgtcttacaccgcctccgtttcttgaggaaccaccgtttccgatatgatcgcttttttcgagtacgatcacggaaaccccttcttttgccagataataagctgttgcgcatccgatgattccaccaccgataattactacttccgcattattcttcatcttcctcgccctcctttgcctctgccgcaaacacgcgcatctcgatcggacgcatcggtgcccgggatgttgccggttccagttctgccggggatacgttcagttctcttgccacgattcctttgaccagctttgcacaggtctgtccctgacagagtcccatgccagttcttaaataccggcggatctccgtcagtgtgaacattccatcgtgcaccgctttgcgaatctcccctttggttacttcctcgcaccggcagatgatcatatcgtcatccggtcccggtacgaaaggtccgatatctcttgatctatcattaatctcatgcataattttttcctcctctgtgaatcaggcttctgccttacgataaaatctggccttcattgccatatctgccggcaccttaatcgtcagcagattcgtatggtcaaatgccttcgatgtcctgacggataccacttccgcctcacagattttttcaccgctccggctcattccgtatcccttttctcccttttccggaagtggaaggaattcatatggaagcgtcacggttgcaaatcccggctcatacgtttcatcgactaagaagattgcctgtccggagcaggatgccacgcacataccgcatccgatgcaatccacatccggatctaccaccggaagggaggtaatattttctccaatcctgatgcaatgcttcgggcatgcatcctgacatgggttacacggaatgttctgtgtacattccatcaccggatgaaccccgactttgtgtgtcacgcccgggaagcgttcgatttcatcatctgcaacatatccttttttcagaagattcatggaaatatcgattccttcttctgtcttctcgataagttttccacgattctttggagcaaacatgccctgacgcagtccgtcaagtgcatcctcctgttcttttacctttgtctttaattcttcctcatccatatatcccaggtaatgggcagctgcgattcctgcgatacgtccctcgatcatggcagagctggcttcctcgatccccgatacatcgcctgctacgaaaatgcccttgatcgaagtttcgccatattcatcacagatcggaacctgtccgccacgctttggattgtcttccatctcgcagcccgccattttcaacagctgcgacataggagaaagtccgactgccaggcagatcgtatccacatcgaaatgcttttcggttcccggaatgaactggaagtggtcatccacttctgcaatcgtaacaccggtcacatactcctcgccctctgcttttacgatggtatgggaaagataaaacggaacaccggttcgtgcaacctttgctgcatggactccgtacccaccgacacggggtgctgcatcaaccagtgcaaccacatcacagccgcactgcatcagctggaaggatacgaccagaccgacatttccggaaccaagcatcagaattttgtttcccggttttaccccgtgcagattcatcatcgtctgtgcggctcctgcaccgatgactcccggaagattccagccctcaaaggtaaccatattttctgcggctcctgtagcaatgataatggaatctcctttgtagtgatgaatctcatctttgatccttaccacaatttctttatccagatacatgccgataacggttgcattcagcacaactttcacaccggcatccgctgcttcctgcaacagctgctgcccgatcacaaaacctctgacttttgccttatgttcctttgatccaaagaatttatggatctgcttaaacagctgtccacccggcttctcattttcatcaaatactacaactttcagtccccgctttgctgcctcaactgctgcagacaatccggatggaccggctcctacgataatcagatcataacgcttcatattactcactcccctctactgttcttcaaacggtttatccgatacgccgtactgtgtctggactttcatgccctctgcaagcggtgtcatgcaggtgcggacatttggttttccatccacgaccatcacgcagtcggtgcatcttccgatcgcacagaagattcctctcggtttgtgttcctttttggtataacggtgaaccatcacgcctgcggcttttaatgctgcggcaattggctctccttcgtatccctgtaattctttaccgtcataggtgaatgtaaccagtttccctttctgctgttctccaaggattggatgttctgaaattctgctgctcatataactccttcctttctatgtgtaatcatgtatggtttccgtgaaaatcaaaaagacacctatgatttctcatagacgcctttgtctaatgtggtgccccgtaaggggtatcgccttcgtacatcgcttccgcgtgagcggaactctcatgcgatgtgctccttattgcggtgccccgtaaggggtatcgcctgcggtacatctccgatgtatcgccctccattatgttttttctaagaaccaattacttttcttaacttgtccttatcataccctctctcccaacacatgtattgtaaaaaacgatacaacaaaaaagaagctgtgcattcatgcaacagcttccttctttgttttcatctccgacaaattatctttcaatcacttttttgattgctgcaaacagctcatcgtaagtctcgtatgcaggaatatccggatattcagccttgatggcatcggtacttttaaataaaaaaccagccttgctggcctggatcatgccaagatcattgtgactgtctccgctagcgatggtatcataaccgatggactgtaatgccttgacggttgtgtacttggacttctcacagcgcatcttaaagcctgtgatctctccgttatcggcaacttcaagcgagttgcagaaaattgtcgggtatccgagttttttcataagcggacctgcaaactgggaaaacgtatcactgatgataatcacctgtgtcatggcacgcagtttatccaaaaattcctttgcgcccggaatcggatcgatctttgcgatggtctcctgaatctcttttagtccaagaccgtgctcctttaaaattccgatacggtatttcataagcttatcataatccggctcatccctagttgttctctttaattccggaataccggtctcttctgcaaatgcgatccagatttccggtaccagtacaccttctaagtccaagcaaacaatttccattttttcttcctccatgtgaaaataaatatactactattccgatttagttccattgtaatgaattcggcagtccctgtctagtaccaaaaggagattcctattgattgataaaaacaagagaccacaaattatttctgtgatcccttgtttgtctatctttccaactgctcataccagtcttgtggaaaccctatatgttttaacgatatgtcatcctcatattcttctattacagcccttaattctgtcataaccttgctattccattctttcttatcgggatacaatcgtttaagaactaatatctgggaaaagaattttctattttgtggtgctacagattcctttggcattttaggtaatgccgtaaatgaccaatcatataaccttgaataatgggcacatcgatttcttaagtcagtaatacaacgtaaccagctttttaaacacgctactgacgtatcatatatctcttttgctatatatttctgatcgcccgattgtaaatccgcataaaaataagacagcatccccatcgaaaagaattcgataattacccatatcggaaattttccatcatatttttccttatgatgcttaacaactaaactgtttttattttcctctatgcaaacattcagtagttttctaaatttatcatgattgtgttttttattataaatactcttatccatgtaccccaaagatccatagacatgtccacagtaataagcaagttgtgttcttaaatgtaattcaattctctctatacaattaaacagtactcctcgtaatttactatcaaacttataaattcgttgaattctattaaaacttatatctgcaaaatatgttccattcttttttctaaacggaagaaaataagcagataaacgataatagtttgcctgctttaaaaaactgatacattccgtatcattattcactataaagcctttttctttgataagttccacttgctgttcataggttttcggctgttttataatttgataatcatgccctgctttactatgattttcccgtaccccatcgcttatatccactattatttctcccaaaataaaaatgtctccccatgggacacatcacttacgtgagaggtgtggggagtcctgttgatattataatatgctatttctataaaaatcgcaaccattttttaatttattttttctgtctaaatacaatcgttactcttcacttctgttgtgccataaatcttcggtaaaagaacacccccaccagcgtggtaagaacttccgtcaccggaaaagtaaaccagaaataattaagtcccagacgggaaaacaaatattcaagcggtacaaacagaatcatcgtgcgcacgacggtaagaagcgaacttttgactgctgcaccaaccgcctgaaaaaataccggaaaaatcagggaagtaaccatcgggataaaactgattcccacaaaatgaaacccaacggttccaatcgcaatcacctgtggatcacttgtaaatacccgaagcatctgtccaggaatcagattgaaaactaacgtcccgataaacatcagccccatgcctcccacaagcgaagtggacaatgttttcttacagcgatccatctgccccgaagcataattgtagctgatcaccggtacaatacaagtctgcagtgcgcccagcggtataaagaaaaaagactgccatttgtaataaagccccagtgccgtgacggcctgatctgaaaatgttgcaaggatcagattaagtccgagaatataaaaagtatatgccgactgcattaaaatattggggattccgagcttgtaaataaagcagataccttttggatacaccgaaagctggggcgatttacaaaatccttttctcattacgataagagccgccacaatctgtcccacaaccgttgcaatggccgccccggcaattccaagctttggcagaccaaacataccaaaaataaacaacgggtccagtactatattgaccaatgccccgacaatctgcgcaatcatcggtgtccgcatatctccattcgcctgtaaaatctttgtccagatactttctgtaaacagtccgatgctgaatacgcagacgatccggccgtatacaatcacatcctttatgacttccggggaatccgtagacatacgcgcatatgcgggcataaaaaggaagcatatcagtgcaaacaatacccacagaaccagtgtaagcggtgttccgatcccgccatattcatttgcttttttctcatcatgcacaccaagataatgtgccattgccgtattgatcccgactcccgttcctacagcaatggcaatcataagaagctgcaatggataaataatggaaagtgccgtcagtccactccccgaatattttccgacaaataaactgtctacgatgttataaagcgcctggatcagctgggcgagcatgaccggaggcgcaattttcagcagaattctgctgattttttccgttccgaaataattgctgtttgtggtttccataaaataatcccctgtgaaaattcgtatttccacaggggattttacgcccgaaaatcatacaagtcaatctgtttttcccatccatttacaccagcctgcgatgctttttcttttctaaaatttataaatgataagcatacacgcgtgcttcatatgcctgcagcatttcttctttctgtttggaataatttccgatcaaaagcttggcatctgcaggaatctgttccgttacttcttgcggaatggaaacttctttttccgtaaaattacaaagcaccatcagccgctgcgtcccgagcattctggtatagataaataatgcctcatcctccggtgctaacagttcgtaatcgccataaacgataatctcgttctcatgacgcaggcgaatcagttttttgtagtacgaaaagacagaatccggatcgctgatctcctgttttgcattgacctttggataattactgtttaccttaatccacggagttcctgtggtaaaaccagcatttgcactgtcatcccactgcatcggcgtgcgcgcattgtcgcggctgatccgctttaaatatcccatcatttcttcatgagatactccacaggtttccgtcagctctttgtatgcattcaggctttcaatatcccggtaatcctctaactgatcaaaataagcattacacatgccaagttcttccccctgataaacatatggcgttccctgcatcatatgcagacaggttcccagcattttggccgaaatttcccgatactgttcactgtcatttccaaaccaggaaaccgagcgcggctgatcatgattggataaaaacaaactgttccaggctttgccttccagtccggtctgccatctggataaaatcttcttccataccggaagcggcatcttatggctgtcccatttaccgtaatggttgtctgcctccggtccgcctccggtatgttcgaactggaaaaccatgttcagttcgctgccatctgcattggcatatttttttgcctcttccagcgtcactccggcagcctcccctaccgtgatcagatcataatgggaaagcactttccggttcatttcttttaaatactcatgcacatgcggaccgttcgcacaaccgctgtctgcgtatccggtttctcccggaattccatccggcagtccttccggtttggaaatcaggctgatcacgtccatacggaatccatcaatgcctttttcacaccaccagttcatcatctcaaacacctgatcccgcacttttggattgtcccagttgagatccggctgttttttcgaaaacagatgcaggaaatacatatctgtctgtgggtcatatttccatgccgaaccactgaaacaggatccccagttattcggctcttttccgtcttttccttttctccagatataaaaatcgcggtatggattatccacactctttctgctttccacaaaccatgcatgctcatcggatgtatgattgacaaccagatccatcatgatcttaattcccagctcatgtgcccgtgcaagcatcctgtcataatcttccatggttccgaattcttccatgattgcctgataatcgctgatatcatatccattgtcatcattcggtgactgataaaccggggacagccagatcacatcaattccaagttctttgaggtactctaatttttctgtaataccattgagatccccgatgccgtctccatttgaatccatgaaactccgcggataaatctgatatacaaccgcttctttccaccatgccttattcaataccgtatcctccttgcctctctcatatttgaatacctgcattatacggcatttttacggaattttctttcacattactgcgcaaaaataaaacaattctgccctcatttctacgcttagattatttttgtttcctccaactgctcggtaaacgcttcgttcatccggataatcggtttacgaagtacaagtcccataaaaagtgcaatcaccaggaagatgccaagttttgccagatctatccagtaatcgttcccataacagcctccaaccgattcccgcagggctgccatactgtgcgtaaacggcagaagcggatacacagcccggaaaaatttcggagcacattcaatcgggaaagttccaccggttcccgcaacctgcataacaagtaaaaccacactgcctgcttttccgatatctccaaatgaaaccgtcagcgtataactgatcgtgacatagactatgcttgaaaaccagcacccaaataaaaacagaaacgtatgcgcacactgaatcccaagataatacagatctcccagtgcaatcagcgtactctgcaacagaccaaggatcagaaatatgatccagcgtccaagataaatttcatgaattttgacatttttcagtcccatcttttttatgctttcctcggaaacggtcacttttaacattgcaaccagcacgattccgccgatccagatagaaagtgtcgaataaaacggtgccatggaagaaccataattatcaatcggataaattttcttcgtattcagttccactggtgccgacaggaaggcactgaccccggacttattatcatagatcatatgttccagatccgcataatccccgttgtcttttgcttttgtgagcttatccgtaatcttttttattttatttgcagatttgcgtaaaagtttaccggaatcatccagacaggtctgtatttctgacagatccgatcctgcggtgtccgttaacgtgtaaacaccctttgtacttgcattgatctgtttcgtcagaccggtaatgtcttttgatgtttcaccgatcgaatctgcaaggttctgcagagttccttttacatccttttcatattctttgctgatctgctgcaggcgtttctgattttcttttacaagggcatccaaagctttcttgtcagagatcaggctggttgtggacttcctcatggaagccgcagtatcggtcagatcatcccgcagttcttcctgtttttcaatagaacggttgatcttttcaatcataggtcctattgaggaatcggtttccggatgtttttccgaaagcttgatcagatgatcccggagtgtcgtaaatgacttgatgtttttatccaccgtctttgctgcttttacaagggtatctgctgtatcctcactgccatttattccatcttccaccgtctgatcccaaagcaggctcatttcagaatataccttttggcctgctttcagtgctttgcccacgctctcggtcgcactgcttattgtcgttttcatatcggtaaacgtctttttggaattttccagaacctgttttccatccgcagactctgttttcagttcttttaaaaaatcagaagacgcagtcagcagggactgggaagaagacgtaatccctgaaaaagtttccagcgtggacgcaatcatatccatgtcatccgatgcatccccaagattgtggatcagattatccaccagccggtctgctccgtttgcctcagccatattagagaccgactgaaacaccgtcattgccgtgtcggatattgtctgtataaatacctgattcacctgtttctggatcgcggttgcacccttgtcggtcacttttggtgcaatcgcattttccttggcgttggaatagtaaataatttccggcttttgaatctgatcggaaaacagactcatcatctgggtactgaatttctccggaacaacaatcgccgcataatattgtccggattttaccccctccattgccttttctttgctggtaaatacccagtccatctgtgtattttcccttagtgcggaaatcacctgttcccctacattaatctcaagaggaatcagacttccggtatatccctcatccacacttgccaccgcgacctttaaatttcccgtattgttatacggatcccagcttgccgcaatattaaaccatgcatacagacacggaacgacaaggacaccgatgacaacaatcattgcgattacatttttgcgaatccgtttcacgtcgtcgatgaaaattttcagaatgtttttcatttgctgttctcctccttcaaaattttcatcagttcctcagaactcatctctcccaaaacagatttctttttcatctcttcatgcagatattccacaatcagcagatacagaatcagtgcaagtaaagaaacgatccacaaaatcagatagaccagtttggattccaggctaaacatcaaaatcagaaatacgagtggtataaccatcatacagataaatccggagcgtaccataaccggataatatttttcaaacgcgagtgttttctctgttaatttctttctccacgcatcatctttcataatcacctgcataatccgctgcagctgtggattatccctgcctttggaatccgtctcacagatcatcagatcggtttctgcaagtctgacatcaaacagatgattcagattcatcagaagcggacggagtacaagcccgataaacaatgcgaccagtaaaaataccagaagttttcccaggccgcttctataagtatgatgatagtatccggcaatacattcccgcattgcgctgatcgaataagaaaacggaagcagcggatgcagtctctggaaaaattccggcatcatttcaatcggatacgttccggaagaacccggaatctgtaaaattaccagaagaaccgccagtgcttttcccatgtgtttaaacgtcgatgccagtgcaaagatcagattcacatagacaaaggaagttaacattccggcaagaataaattttaccggatgcagacactgtactttcagcagaataatatctcccgcacatacgatagctccctgaatcagtcctatgataagaaacagcagaatacgcccgaaatacgcacttgtcggtgtaaaatccggcacttctttgtcccggtctacttcctgttttaaaatagaaaccagtatcagtccacctacccagagtgccaggtttgtataaaacggggtcattcctgttccgtaattttccacttcatacaggacatccgtctttatgtttaccggagaagacataaaattggaaatatctttggcatcaatcttttccagtgacaggatattctgatacatatccgaattctgcagtgtctgcagatccgtgaccgttttctgcagtttctgatccacctgtcccatgacattgcccgtctgtgtaaatactttggagctgctgtgcaatgcagattttaactgatccagcagatctctcatctgttttgtcatggatgttatgctatgtaaggttgttgacagatctccgcttatatctgccagaccttccagtgactgatccagctgcgggtaaatatttttgctgaaatcgatcctgctgtcctgaaaactctcacggttatcctctgcaagcgtttccagtgaacttctcgtatctttggaattctttaacactttccgcatactggtatttgcacttttcaatgaatttaccagtttctgcgcagaaatgctctgcgtctgcagctgtgaaattttctgtccgacagatgctgataactgtgtatcttttccaagattctgatttaacttttccagatctttgagaagcttggcatttttctcattgatccgggtgatcgtatcgagactgtccccaaccgcaagatttgccttatctgcctttatctcaaacttattcagactcttagaagccgaggacgaaacttcatccagaaaaacttccccgccggtcagcccattggagaactgtttataaaattttccaagtgccgtctgacttttttccagcaatgcagaagtttcttttaaagaagaagagctgtcctttgctgcctcatccacctgatctaaagactccttgatttctttgatctgtgcatcggatttatctacttttttctgaaattcttttaccagcttctgataatccgttaaattattctgaacttcggtaatggcagatgtcagttccgactgtgtatcgtccagtcctctggtaatactgtctgcggaagactttacaatttctgatactgccgaagatgccgtggcggaaaatgtgtcgttgatctgctgttgcaccgttgtcgcaccggtatccgtaatcttcggtgcaatggcatttttcttttcattgacataatagtccagcttcgggcgtttcaggtctccggagagaatacttaccagggaactactgaaattctccggaatgacgattgccgcatagtaatctcctgcctgaacaccttcttttgctttctcttcactgacaaactgccagcccagcgacttgttttctttcagtttttcaacaatcgaatcgcctgcattcatcgtgatcacatcggttttggcccctgtatcgcaattggcaattgccaccctgattcccgaagtatttgcatacgggtccatgtttgcggcaatattaaaccatgcatacaaagacggcaggagacatacgccgatcataaccagtgtcgcggcacggttttttaacagacgtcgcacatccctgcggaaaatctgaaatgctgtcttcattcattacctctttctattctcagtttcttaatgaaaaaaggaaaatggctttttcagccattccccttttttattataaagagttctatatgaatgttcaaccgaaacttgaaaattattagaacgtattatttggacgcagatattagaattttctctgttcacagaaaacctatcttcctaaaatcatgtccttatttttcatcattgcataccttatcatgccggcaaacaacaacaagagtccaaccataatcactacagttgccgcaacacaaaaccataacgcgccctgcacaccagaggcaaagatcctgtaatacaatacagacgcacagcctccaatgacaagccctatagcaatgccattccttccatatccgaaaaactcttttgcaagcatctgtttctcctgcttcggtgtcatgccgaccgagcgcagaatgacaaattcccgtctccgctgccacagatcggtcagcaccgtattacagatgttcgtcacaccgattaaaagcactgcaagcaaaaatccatagagtgcaattccatctacaaacaacagcatattgttttcccggttctgcagatcgcggtttcggatttcctccggataaaaatcataggttttttccagtgcctgtgtgagcgttcccggatcggtactggcgtattttacggtaatttttgcaccgccctgcggatcgtgggcatcaagccatgcatcactgacaatgatggttccggagtctgtatagctctgcgacgtatcgacaccaaacggccgcctggttgtgactgctgcgatctgcatctgatcggtcatgtccggtgttttctccatctgttcttcgtggcagaactgtcccctgatccagtcgcctggtttgtaatctgtcaccttccatgtggtttcctttccatcccagtacccggcatacgcattgtaaaatatcgcacaatcttttgccgtttcataggaaagtcccagttctttcaggtaattgcggtacgctgtttctccgactgccagtacctggatcactgcggtcgtctcatgtttaagatccggcgctccatttcgtcggatatgcgtctgtgtatacggtacctctttcgtattcaccatatatgccgccgtccgcaggactgccgcttccgtgacgcttttttcctttgtgctctgcaaaaccgcagaccggtttgcctcccagcttccctgcacatccaccgaaacattggcatgatcgtcaaacatatggttgctttgtcctaccgaaatcgtctgtactcccataaaataggataccagaataaaaagcgccgtacatcctgcgattgcagccgtgatcgtccgcttttttgcccggcggcttttctttgcctgcccgcgcattgccgcaaccggagaactttttgccgcctgttttgccggacggcgcgcggaaagaacaagagtgacagttgagagtaaaataccggcgataagcatctgccatgccacatgaacatgcagatactgtacggtattctgcccgtacaacaacgctttgatagcaaaaattccgcctgtcgaaagcaacagtcccagcacagttcccaggggaattgcggtgcgccctgtcagaaatgcctcgtaatacacactttgccgaatctgccgcggtgtggcaccgaccgaggcaagcatgccgtaactctttcgcttttcctccatggaaatagcaaagctactaccgatgcagcttaccgccgctgccagaatgataacatttgtgaccgcaactgcaagatagagcatgtgatacgccgactggccgatatccatgcgctcaaatcttatcagcccccagttttcataaaaccggtacaaagaccgctccatcagatcattaatctggcggtttgtgatgcgttcatctttgataaacggaaatttctgtacgccgggggtaagtgtaacacccacaatatccgctgtcgtctgtgcccggtcacgcaaccctgctttcgtgtacttgcaataaatatccgtgcgctgcatgtacttttccgggatattatctccctttggattcagatatgtaattacactgtagcccggtgctgtccactcctcaaatccaaagttcggacgctgcacaatgccaaccacctgaaaagatgccgttaatttctttttcagtttttctcccgttcggtaaccactcgactgtgtcagtacattcccgttcttatcctcacgttcggaaatgtccagtgtgatcgtatcccccacacgatattccacaccaccgttcgtcatcatatgccgggaaagcaaaatctcatgatcgtttttgggcatacgtcccttgatcagatgcagggcatttttctgcatggcccgattgtccattgcggtcagatacacatacggtttatcgggatttttactgccggaaagctttgcataccccagcccgacactctggtatgcggtcgcaaccttgcggttatttacaatgtgatccgcctcctcacgcggcacatcgtaaaatacatagtcataatctccgcttaaatcctttgcatattcgatcagtcccgcctgacaggacgaagcaaaggaaaaaactgcggcaaacaacgccgtggcaatgcaggttgtgatccacacggcaatggtctgccgtctgtttttctttcgctcacggattatccgttttttcataatggaagtaaccatgcctatccctcccttatgatttttccatcttcaatgacaatcacacggtcggcggtctttgcgatctcgagattatgcgtgatcatgatgatggtctgtctgtattcctgattcgctctgcgcagcagctcaacgatctcgtcactgttctttttatccagatttccggttggttcatctgccagaacaattgccggacggttgatcagtgcccgcccgatggatacgcgctgctgctgtccgccggagagttcttccggaagatgcgtttttcttccgttaagtcccagctcatcgatcagtttatccagacgctttttatccaccgtctgtccgtcaagttcacacggcagtgtaatgttttcctccacatttaatgtcgggatcaggttgaaaaactgatagatcagaccgatctgcctgcgccggaaaattgccagtttttccgtgctcagcgtgtagatgtcttctccctgtatccagactttcccctccgttggctgatccacgccgcctaacatatgaagcagtgtcgattttccgcttccggaactgccgacaacggccacaaattcgccctgtgcgacggaaagagacagatcattgactgcggtcacacttgtattgcctttgccatagatcttcgtaagatgttctgctcttaaaatttccattgtgttctttcctcctctacaggtttcatcttacggatggcaggtgacatctccgtgacatttttcaaatttgtcaggttattttaagtattttatgataaaaacgttgtatccattttcggattcaacactcagataagcattttgtttttcaagaatggcttttgcaaggggcagtccgattccgatattgctgcttccatcgtttgcggcactgtaatagcgttcaaaaattttctttatcttttcttttgtgatcggtgcccccggatttgctatggagacagacgtataaactgcattatccgaaagcgttaccgtcacggtttcgccctttttgctgtgctcaatggcatttttcagaatgttttgtaccgcttcgcggttccagtccaaatcgcccacccgcagcacctgtgcttccatgccgcaaacgcggatttttatgcctttcagttccgcaaaaatttccagatgatcgattgcctccgtaagcatccggttgacggaaaacggctcttttttcagtgcaaccattcccgcatccagccgggacagttttaacatagctacgatcatccagttcatggaataaatctgccgggagatttcgcgcagaaaacgcctgcgggtttccggcggcatctgctcattttcattgaggttatccagcagaatggatgctgaagtaagcggtgttttcaactggtgggaaatgtccgcaaccgattctgcaagcgcggtctttttctcttttgcgtggtcggattcttcttttagaaacagcgtgatcttgtaaagctggtttttcagatggcttagttcatcctccgtgttgtccgccagtgccagatcataatgaccgcgaacgatttcttccatgtaatccgacagttccgcaagtttacggctccgccgtttctgataaatgaaaaacagacctccggctgcaagttccgccagtagcacaccgccaagcgtcctcaaaagaatcctgcgttccatggtttttgttccggcaatcaccgattccgcctctgatatgccataactttgcaggattttttctgcttcttttatctctttctgatgggatttctgatatgcatgcggttgctctaacatgtgcatgcactctgatattttttcctgtctggatttctctgtgtcaacgccatcggttttcagtacgatgccaagcattgcagttactgcctcattttcttttacacgatagccgcgaactgcaaacattgccacagttcctgaaagaactaaaataataacactacaccatagaaaacaccggaatagtttttttgcttctttattttcgtattccattatttatcactgtaatgccctttgcattgtaccacttcaatcattccctccgtcacttcataaaccagacggtctttctgattaattctgcggctccatttaccactcaaatcaccccgtaatccttccggttctcccttcccatcgaaaggcgtcctttgtatatctttgagcagttcatttatttttttcaatgtcttcctgtcctgcatctgccaatacaaatagtccttccatgcctcctccgaaaatgtaattttactcacccgccatagcctccagttcttccatcgtttttaccacaaccttcccctctttgatctggcgatcggattcccgaatgtgttccagattggttctcgaatagaatggatcctgtggtgcttcaatttcaaacggaattttccgttctctcaatgcctttttcgtatacaccatataaaatgtggaaatattcattcccattgcttcacacatttcatccagttcctttttcatctcatcatccatacgcaaactaattgttgtcatattctcacacctttctgcaatatttaatacatatgctttcattttacatatattatattcttttttatgaaaattatcaatattttgtcacagattcagccgatacccgatcccacgcaccgtgacaatcacattcccctctttgtcgcctagtttttcgcgcagacgcttcattgtaacggtcaacgtattgtcattgacaaaatttcctgccatatcccagattccgtttaaaatttcctcgcgcgtaaaaattttatgcggattggaaaataaagtcataagaattttgtattcgagctttgtcaccacgatcggttccccgtcccgatagactttgcccgtgtccggttccaccgcaatatttccacaggtcagccgccggattttttcggtcctgcgcagcacattgcggatgcgcgacaccaattcccgatttcgaaacggcttgatcacataatcatccgctccgagatcaaatccgagcaccacatctttttcctcatcctttgccgtcagaaaaatgaccggtgcaatgtcatgttccttaattttcccgcacagatcaaatccgtttccatccggaagggaaacgtcaagaagcacaagatccacctgcctgctggcaagaagatcctgtgcttctttctttgtttttgccgctaaaaacgtatattgttcttctgtcagaagatattctaaccccatgatgattgactcgttatcctcgatcagtaaaattgtctcattcatactgccttttcctctgtttttcaacattctgcttattataataaaagaaacgaaaggaaaagtccagccgtccatcagacttccagccggtggtatcttcgttttcccacagccatcaagcagaccgcagccgttccactgcagaataacacggcaaattcatttcctgcaaacgacaggcacagatcattttccataaaccagcctccgctggttgcatacagtactgtgggattaaataattcccggataagatcccacacatttcccatctgcacataggcaagcagatatgcccccataaaaagaagacccaataccgcaaacgaaaaataactgttctgtaaaaacaactgcactgcggcagtaacagccgcaacgatcccaagcagtcccacaagcaccaccagcgcaagcaaaagataacgccactgctccagccgccagaacgtgacaaacggatacatcatctgcagccgcggctctgcaaccatacatgccgccaccggaacatgccacaggttctgaaacggaaccgctgcaaaaaataccaagagggtaaacactgtaagcagtcctgcataaaacagcccgcacaacgttcctgcaagcattttcttttccatcattttctttccggtggtggtcgccaaaaccagatcctgcgtcttatatatcctctcataatccatcagatacagcatcgaaagaatcatcagaaccgcggtctgcaaaatcagttttttccacagctttccatacaaagtggtgtgcagtttataccagtttcccggataaaaggcatacgtgccttcccctgtttttctaatctgttccacccgcttctgcaatcggtcataattgcgtacaatccacgatccccagactccctgcggttcatatccactctttttttctttctgttccagaatcttatgcatatccagtgtatcatacattccgccataggtctttttatagtccgcataggcactttcatactccgggcttgccgtctcctcatccgtcacagccacatgcatctgccgcagttcctttctcatgccggcatttcccacataggtatagatactcaaaaactgaaacagcccgaatgtgatacagacaatccacagaaacggatgccgcagacattttccacactctttttgtaaaaggcgcatcccttacctcctttgcaatcatctatcgtcagagatctctgtaatgatccctgtgcattttccaccacagcacgcacgcgcatgccaaaatccaccccagaatccaaagcacttctgaataaggcaggctattttcatccatcggcttctgaaacagatgtacaaaaatgtgtgtcagcaaaaagccaattcctgcgcatgccggaatggcaaatgcaattcccgcaatgtaattgcctgccgttcttccgatcaggtaaatcaaaacaaccgcagccagcacaaacacaaaaaccagcagcatgtaaagtagcatatagaaaccaaatggcagatttttacaccacaactgcagtcccgtatcgttgatacaatcgcctttccagaataccgccagtccttttatgacataaaccagtacataaataccaaattgtacgattcccacaaaaccgcagcaggccacaagtgcctgaaactgcctgtcaaaaagtttccgcccggtagcagtcgttgcatacaatggcagcacatgacataaccgttcccgtatcagatacggcagtgcaaggattgcaaaacaaatcagaagcagaattcccatcattctcatatctttttctacaatataaaaaattccacccggcattagagagatactgtctccattctgtaaatttttgtattcatccagccgatcgagcacctgaagttcaaaaaacagttttgacccttttgaatcctcaaagaccagacgcgacagttcctgatcgattttcttttcctcatcggttaaagtatccttatcaaaaaatgtttcctgtgtcttcgaaaattcctgataattcgtaatttttgcatctgcaagaacctgatccgccgcaatgatccgggtgtatgcctcttccagttcttttcttttttcatccagcttcgaccagtcctcacgcggcagcgaagttccccagctttcgatcagttcggcgtaaaacggcatatcatactgggaatctgttgtctgccctcccgccggataaatcgtcacttccaaaaacaaatgataaaacagcaccgtaaatactgctataacaagcaatacccggatatccatgatttttttacattcttttatcaatattttcatgccggttcctcctgatatgtaaccagaaatacatcttccagattcggcgtacaattcctactgccttcctccggcttgctgctgtaataacgcacctgcatatgttcctgctcctgccgcacagaaagaatcagatgcgtgtcttgaaatgcatcaaacgcacggtcttccatcacgcactcatacacctttccatcaagcgttttacaaatattggaaaccgtgtccatccggtatagtttacgttcttttaacagaatcacctgattggcattcgactcaatatccgacacaatatgcgtggaaagaatgacaatccggtcctttgacaacgttgacaggatattgcggaagcgcgcccgctcctttggatcaagtcccgcagtcggttcatccagtatcaggattttcggatcatttaacattgcctgtgcaattcccacccgctggatcattcctccggaaaattttttcatttttttgtctgccacatcagaaagtccgaccagttcaagcagttgttctatcttttcttttgcggtctgctttggcatatttttaagtgctgccagataatccagatactgcacgggtgtgttgtttttgtaatatccaaactgctgcggcagataccccagcagatcccggtatttttccccgagttttgcaacaggaatcccatcccataaaatttctccctgtgtaggaaccagcaaggttgcaatcatttttatgagagttgtctttcccgcaccgtttggggcaagcattccgtaaagcccatgctccatctcaagactgatgtcttccaccgccggaaattttccgtaacttttgctaacatgcgaaagagtaagcatcttttttctccacctttcctattgatacgaacaaaagacaaaagcttgcggcagtgaccgcgccgtgcaccgccagcggaaccgatgtaaaaagaaacatctgcacgccagttcccgcaagccttgcaatcacgcacacacacgcccagactgcgatcagacctgcataaaacagaccacccgcgcctttgtggcaggcatatacacagaccgaagcaaacaaaaacacactgctgcttcccaccagaaccatactcacaaatgcttttcccgaaacatccgtaaataaagctgctccggtcacattgaccagtatcatgatcacgcctgcatacagcatgcgaagtcccgacagatagctctgggaataatgaagcgaggcgatcagatcctgcatgtggttctgcgcatccagccaccatgccagtgccgcaaacaccagaaaacagaccggaaatcctaaaaacacaatcattctctgcgtttcgggctgctttgcatatgactgtccgagccatccgattcccagatacagacaggcaacaatgagccagatacttccgctctgataaaatatggcacgaatgcccggtccccagtaaatttctttgattctttcccacagactctgccgctttggtattgctttttccacaatcgcacaacattccttctgcataacgctatcctccgggaattctactggaagcagtggtattttctgttctttcttccattccttttccttcatctttgcacctcctgccgaatcctttttaacatctggtaaaaccgggtctttacggtactctccgcaagatccatctcctctgcaatctgcgcaaatgttttctcctcaaagcattttttctgaaaaatgcgaatccattcgcgctcataggaaacgacaatatccataatccggcgaatctcttctttttgaaccatatgctccgccagatcacgcacagttttttcctcctctgtttcccattgcaggggctgctgcagtttctcctttttataacttttactgcgataataatctgtgatcctgttggctgccacacggtatgcccaggtgcggaagcccgcctttttctcatcaaacgcataaattccctgcaaaaccgtgataaaaatttcctgtgtcagatcaagcgcaagttccctctctccggtctgccgataggtaaacgcatagatttcccggtagtatcgccggatcagttcatccgccgcttttttatcctgttttttcttaattctgcggattaactggttgtctgtctgcatgcatgttcaccgcctttatctccgttcactcagatatacgaaatatgatacaaaatagttgggattctgaaaagatttttcaaaaacaaaaaagagccggtgcaaaatcaatttgcaccggtttccttttgtaacactttttatgcttccttccgcagttcctttgccgcctccacaagatgtttcaagctggcaacggtctccggtacgccgcgggtttttaatccacagtccggatttacccagagcttctccggagcgatacgggtgagcattttttcaagtgctgccttgatttcctctactgacggtacacgtggggaatggatatcgtacacgcccggtcctacctccgtcttgaaatggttctcctttaaggaatccagaatcagcagatcggaacgggatgcctcaaacgtaatgacatcggcatccatgtcgtcgattgcgcggatgatatcggtaaactcgctgtagcacatatgggtgtggatctgtgtctgtgctttcacaccgctgtgtaccagacggaatgccggaattgcccagtcaagatattctttgtaccagtcactcctgcgcagcggaagcttctcgcggagtgccgcctcgtcaacctggatcacacggataccgtttgcctcaagatcgagcacctcatcccgaatggcaagtgcgatctgataggtgctttcctttaaggaaatgtcctcacgcgggaaagaccagtttaaaatcgtaaccggaccggtcagcatgcccttcatcggcttctttgtcaggctctgtgcataaacggaccagtccacggtcatcggcttttcgcgggatacatccccccagatgactggcggcttcacgcagcgggtaccataagactgcacccatgccttctcggtaaacagataaccactcagctgctcgccgaaatattccaccatgtcatttcgctcaaactccccgtgcaccagcacatcgagtccgatctccttctggatctgtacccactcagcaatcttctttttattaaattccacataggcttcttcgctgatctctcccttgcggcgtgccgtacggtttttcttgacatccgcagtctgtgggaaagaaccgatcgttgtcgtcgggaataccggcagcgcaaactcttttttctgaatcgcttcacgctctttaaataccggaagtctggtaaagtcttcctcacgaatcgctgctacacgctcctgtaccgcattgtttctgcaatccggacgggtggcaaacaaagaggtattttccagaaatgccgcatccagtttgtaatcaacgtctgccagtttctttaactctgccagttcctgcagcttctcctctgcaaatgcaaagtgctcggtatatttttccggaagctttgtctcatttttcaatgtatatggcacatgaagcagggagcaggaagtatttaacaccacattgatgttcttcgccttaagcgcatcgatcacttccaaagtctttccgtagttgttcttccagatattttttccattgacaagtcctgcaaacaataccttatcctgtggaaaaccgtttgcttctaccagttcttttgtttttctgccctctaggaaatccagaccgattccgtcaaaagcaagcgctgtgatattgccataacagtcacgcacatccccgaaataggtctgtaacagtactttgcctggtcccttttttgcaaggattccctgatataaggtttcgaataatgcaatgtcttcactggtcagatcatgcaccagatatggttcgtcaaactgtacccattctgcgccggctgcaacaaacttctcaagcaaccctgcgtatgcagcgctcacggcatctgcataatctgtggcctgtttctttcccacataacgcaggagttttaacagggtaaatgcaccgatgatcaccggttttgtggtaatgccaagggcttttgcctctgcaaactcgtcaaagggtttggttccggcaagtttgatctctgtattatcatcgatttccggtaccatgtaatgatagttggtgttgaaccattttttcatggcaagtgccttgacatctccggctgctccctgatacccccttgccatggcaaaataggtatccagtgcagaaagtccaagctttgtgtagcgctctggaataatattgaataatactgccgtatccaatgtcatatcatagaaagaaaaatcatttgacggaatgaaatccagtccggtatttttttgtaatgtccactgggttttgcggatttcttttgcggtattttgtaattcttccacagaaatctcaccgcggaaatatttttctgttgtaaatttcagttcccgtaaggaccccactctcgggtatccgataattgatgttttcattatactctcctgacgtaccatgttgtaaagtttcttttatttgtggcttagtatagcatacgtcagtttttctgcataatatttatttttgtgcttttgttatagttttatactatatccgcatctaaaaatgcagcgacaaaaatcgccggagagttccagtaaatcgtaatttcattcagcgaataacactcccatacatccagaaaacatttcatcggcggtgtatccggtgtgatcagccactctgccttttcatccaccggagcggagtttggaccgcccaccacaaatcccggaatagtctcgtcgattccatccgaaacagtcacacggttatgcggattctgacagctttttgttcccacggcggtcacataactatagccggttgcattcacaccaagaatatagtccatctgcgcctgtgccattttctggtaacgcgcttccccggtcagaagatgcgcaactgcaaggatcatggcgcggttgagcacgaccatgttgctgccccagccatattcttcttttgtcagcgcgacaaaatatccgctgacatctgcaatgtcacagattttatctgcctcgtttaaaaatgcctgccggaatttctgctggcatacctgaaaacgctgtgtttcctttgcttcttttttctttgccccaaacagacaggaaagtcccgccagaccggacacatccacccagcccatatcggttggattttcgtttgtttttaaatagtcctccagcttgtccagatatgcggcgttgcccgtggtcacatacagttccgctgccgcccagagccgctcatccagatccgaggtatcctcatagccgccggtattgcagcctgctggattttcaaatccgataaactgtggatgctgcatcagccagtcccacgcacgcactgcggcatcctccgcttccgctgcaaacgcaggctcccatgtccggtacacgcgggatgccagtgccatgaccgctgcaaaatccgctgccgccattgtcgatgccggaaacaggatcatctgccgtttgtcttcacacggcatcacaaaatttgcatggcgcatcgaagtcagcttatgacagacacttccatcctccatctgcattttcaaaagccagcgtagctcatacaggcactcacttaagacatccggcatcgcatcgttgctttccggaatatttaagttttcggtgaaactctccggaaagagctgctgcgcatagatcatgtgtgcaagcgctgtagccgctgctgtggtatatctgccataatccccggcatcgtgccagcctccggtcacctcatactgttttgcattttcttttctttccagatagtcttccagccgtaccgctgtgcccgtgtgacaggtacaacgcctgaattttccggcaaaggtttcttccagtgccatcccacaacgctggaaatacagtgctttacacagcgtctggttcaatgtatggtatgccttgcggctgatgatacagcttccgagaaccgcaccttccccatcctgaaatgttacagttccttcctctgtaagatcagaaaagtcaatgtgccatactttatcttctgcactctcatcaacgcctgcatataccgcctgttttacagcggtctgctcccctttttcattccagagggacacctttttgtcctgcattttttccatttcatccgcgcggttttcctgcgcaagtaccgcaatcttgcggcctttcggcagataccctgcctgatttgcataaaatctgatcatgttgatactccctgtttttcctacaaaaaaagcagttgaatattcaaactgcttttagcctttctatcttaaattataacttgtttttagcaaaaatcaatcgttcactccaagtctttggcggaccgtgaggaagtatctttaatgctgcggctttccctgctccgcacacataccaccgaaagaatcagacccagcaggacaaaaacgacattggctccggcccaagcggttcgggctccatccgacagcgaaaggtgcagaagcgatggggcaagagccgccagcggtaggatgctcacaatgagcgcagcgatactaactgattgaagttttttcttttccatagttttacctcatttcttttttcccaaattgggtgacagccagcgcgaaaaacaggccaaacactacaatcgcgcacggcaggaacggaaacaccgaaaaagcggcgtcggaagtttctgctgtaaagtcatagagagagcaggaaacgagataaccgctgtaacagtacgggtaggcgatccacagcggcgtattcgcaaccaatacaccgggaatcacaagcagcagatttaatcccacagaaagaagcggcttttcaaacagcacagtgatggtccacatagccgcaatgcacggcaacatagtcagaaacagccccaagcaccatttcagaagatataggatcggcagggtttctgttactcccattgtctgtgtcgcaatcaacccagcgattacaaatacgacaagaaacgccaccatctccataaacagataaaaggtaagcacacagaatttggcaatggataatgcgcagcggctgaccggcagcgccagcattttcagaatcccgttatttccggtttctcgtcctgcgatcatcacgcaaaccacgatcatgctgaatggaagcagatagtaggcgtaaacaagcgcactttgaataaacatggcaggccacgcattggtgtattccggtgtaaagtagttgctcaaactcgcaaccccggaaaccaccaccaataaaggtgcaatgaaaatcaggggtacgattttggagcgttttactttcataaactcgattttgagtaaatccaaaaaactcatttcttattatccctccttactcgtagcgtctgtacttcgccagccacaagcccacagcaaggaacaacagcgtttccaccacagcgacaagggcaaccgtcgaatcaggctgggcgctcatggctactgctggtttcagaataatcaaaaaaggatgcaccagcaaaagcgtcagccccgaatttgcaagggccataccactcagaaaaccggcgacaccaattccaagcggcacccacatattttcaaagcgcgaggaaatcagcagcataaacgacagtaccggcatggatgtgagaaaagagtatccggcaaagcgtaccagcgtacccatctcaaacgctccgtccggcaagtccgtcattccgatctgtgcaagtgccaggttttgcagcacgattgcaaccaaaaacatgaccgtcagaatcagaaatttgcacagatacatggccgggacgctaacgggaagcatatacatcttctttacggcacttcccttaaattccacgttgtagatcatgcaggtaacaaccacgataccgaacagattcagcaccataatcatgccgtagagctgggtcaacaagacatccatcggggccagcggcagattcagaagtgtgtctttccgcacaatgaaattgacaaatgcgtaggcggctcccaagacaccaacggccagcagcacgggaatcacgccggttcgctttcctttccgaagttcgattgccagcgttttcataattttgccctctgctttctgtccatgttatctttctcaaccatagaaagaaacacatcttccagattgtccgcagcgaagccggattgcagggcgtattgacgcagatcattcatgcttccctcaaacagcagccgcccgtggttgagaatcccaatgtcatctgcaatcaattcgatttcagacagcatatgggacgagatcagcaccgtgcagtcgtaaaggctgggcaaggattttaccagattgcggatttcgtggataccagacgggtcaagaccgtttgtgggttcgtccagaatcagaatcggcggacgccccaagagcgccccggcaaggcccaagcgttgcttcattcccagcgaatactgttttgccagacggtcgccaaactcggtcagccctaccagttccagagcatcttccacatcagctttcggcagtcccaaaatgcggcggataatgtcaagattttcccgcccggtgagatttgcgtagaaagatggcgcttcgatgaaagagccgatctttttgagaatggcaatccgatcctgcggaaactgtttcccatcaatggtaaagctgccttttgtgggagcggtcaaccccaacagcattttcatggtagtggatttgcctgccccgttcgggccaagaaaaccataaatgctgcccttgcgaatatgaagcgaaacatgattgaccgaagtgaagttcttatatttcttggtcaaatgttccgttgtaatgatatagtccatagaaacatctcctttcgatgcttctatggtacaacttcaacctgacatctacattctcccgcccttacttttaccttacttttcaaggaacaagaacgcagaatggacagcccatgatataatagaaacaaataaaatcagattggagaaactgctatggataattcctttttacatactaaaaggctcctgttggtagatgatgaacaggaactattgaaaatggtttcagatatattgaaagatgcaggatttgaaactgtccttaccgcaatgacggtcaaagaagctattttgaccgcaaaagaggaaactcccgatttaattgttttggatgtcatgctaccggatggggatggcttttctctgatgcagcatttccgcacttttaccaatgtgccgatcattttcttaacagcaaaggacgaagcagcagacaaattatcgggattggggcttggtgcagatgactacatttctaagccctttatgccgcaggaactgttactgcgtatctatgcggtactgcggcggacctacaaagaggattcaccgctgcttgttttggatggatgtacgattgatttcagccgggccgaagtccataagggcagcgaaattatctccctgacagccaaagaacatactttacttgaaacgcttgcccgtaatgctggaaagattgttaccgtagatgcgctttgtgaagccctctggggggataatccttttggctacgaaaacagcctcaatgctcatgtccggcgcgtccgggaaaagattgaaaccgatccatcaaaacccgtgtccctaataaccattaaaggattaggctataagctgatagcaaggaagtgatgtcatgaaatcattcggaagttatatatctaaatatcttgtgtcgttcgttgcctttattctgatattgctttttcttaatgcagtagtattcggtctgacttttcaaaagattgtgaccgaggattatggcgattcatccccgcaatccatgttggaaatgactgctaccgccgctacgccggaacaattattggatgaggcggtgcaaatgctccgacagaatcatatttgggcgatctacttgaatacagatggtcaatgttattggtcggttgatttgccggacaatgtgccgaaaaattacacaattcaagatgtcgcactattttcaaaagggtatattgaggattacccggtttttatttggaacaccgatgatgggttgttggtgctgggctatcccacagacagctacacaaaactcaccagcaattactattccattgcagcacttcaacgactccccatctttgtgctggggatgcttggcttggatgtgctgtgcctcttttcagcctattacttttccaaacgcagaattattcacaataccgaaccgattgtgtccgctgtggaaactttggcagacggaaagccagtttcacttcatatcagcggagaactatcggaaattgcaagcagtgtaaacaaagcttcttccattttgaataggcaaaatgaagcgcgggcgaactggatcagcggcatttcccatgacatccgcacacctctctccatgattatggggtatgcgggccgtattgcagaaagtaaagctgccagcaagagcatccgtgaacaggcggaaatagtacggaagcaaagtgtaaaaatcaaagagctggtgcaggatttgaatttagtatcgcagttggaatatgagatgcagccgcttcataaagagatggttcgcttatccaaactactgcgatcctatgtagcagacctgttgaatacaggaatttccgataactacaacatcggaattaagatcactcctgacgccgaaaatgctgtgttggaatgtgatgcccgattgatttcgcgggctgtaaacaaccttgtccagaacagcataaaacacaacccacagggctgtgaagtctgcctttcgcttacaacatcgcaaaaccatcttatcttagcggttacggataacggaacgggtctgtctgctgaaaagctgcaagagctggaagaaaaaccgcattatatggaaatcacagatgaacggcttgatttaagacatgggcttggattgctgattgtccaacaagtctccatagctcataacggcaatttcaaacttactaatgttttcccgaaagggtgtgaagctactttaatattcccgtatattggataaacaggcaagtacaaatctataaggaaacgccagatgcagaggtgatacgcccctggatctggcgttttcttaataagcgcacttcaaatcggtataaccttcttattaacactgacaaaaaacaggcgcatcaaatgaaattttatcaaaaatattttccaagctgctttaatccacggcggatactgtctcggacacggcttgggtctacaccttctacttcggcaatttcatttaccgtcatttccagatagtatcgggcataaattcgctttgcctgtttctccggcagcttcaccacagcggcatagacctgctcctgaaactgtttttcctccagaagcatctccggtgtttgcggcttcaatagcaccgcattttcaatgccattctcgcaatccagagaatactgtgctttataacgatacatctttcgctcatacgcagtctccgcacgttcagctgctcgaatagtctccatttggtttgactgataaaaatggactcctgaccaatgccggaaaactcatgagcgatcagcacacggtttataactcccgtatgttctgtacccggtggaatggcttggaaaaaggctctatctttgatgatgcgctggacgataaagaatacgagggaaatttgatttatttactgaacagcggcagtgaatttattcgcaataattccaaagtccgttttgtcaaaaaggcacagtatcgtgtagacaagccggattatgcggaacgagctgtgacagaggctcttgtcaatgcgcttatccatcgtgattatattgtgcttggcagcgaaatccatattgatatgtttgatgatcgggtggaaatcacatctccgggcggtatgtttggcggcggctcaattcaggaatacgatatttacagtattcgttcgatgcgacgaaaccctgtgattgctgacctgttccaccgcatgaagtacatggaacgccgtggaagcggcctacgcaaaatcgtcagtgaaaccgaaaagctgcctggatatacagaggcatataagcctgaattttcctcaacggcaaccgatttcagagttatattaaaaaatgtaaattaccatcatgattactccatcatggatataaaccaagttaagacccaagttaccacttttgatgagattcttgttttttgttcaactcctcattcaaaagctgaaattgcagattattgtggatataaaaacaacaaaaatttcaccaagaaatatctacggcctttactagattccggtacacttaaaatgacaattccaaacaagccaaacactagaaatcaaaaatatattaccgttcgcacagagtgaaataagaagcaggacattgggtttcatccctatcgtcctgcttcttatctattcttaataagcaccaaatgcttgaaattgggtaaaaagaaacccctgtaaaccagtgtttacaagggttccgagtgttctgattattatctctttgttaacgttttgagaacaagaaaagcccataaataggaaatctatagtgggcattgttgcatatgtgttatatgccggtggcttcccatacattcccagaactactcattgccctaatgtttttgccaacaacattattccatcaatcctaatatatcctgttcactccaatattcatttggatatattgatagttcctctttatgcttacgaataattctttctggtgatttagtattatcataaacatgcataatatcacatatatcaagtaactcttttatgttattaattgatttataatatctttcaataactttaccgctatcaacattatgtccacctgctgccacacgggattctattctagcaatattaatttgtggatcaactgtcaacacgaatacacattttatgaaatatccctcttcttttgcttttcttaaaatttttaacttatattcagatgacaagactgtttcaaaggtaaaatcttctgtcttggcaattgattcatatctcatcctgtcaaccaaaacagccgcttccatattattcattcctgtagttgcaacaacatcatcagcattagtatatttaccaactttatcaaaaaaagctgttatagtacttttccctgaaccatttggtcctgctaataccagaatcatcggttttctactctgcatactttctttccccatttgcatattcaatgtaagcttgtttctttttttcatcataacccgctattggttttttacaaatttttgctttatttattgctgccttaacagcttcaactgctctttcgtccatttcattatccgattctgtcaatgtacttttctcttcttctctggatacaacttttataattctaccactctttgtgcttacagttgtcatataaacatctctccttaatacaaaaatagcttctcaattataatatattttatcacattttatataaaaaaacacctcggaaccgaaattccgaggtgtaacatacatttctgaaacgccataaggcgctttgaattgtaactccaatctctttgttaacgcttgctgaactgcggagcgcgacgagctgctttgagaccgtattaaacatctctatggtgcgtttttccttgatattacgggctttttcgcattttctgttgtcggttgtcctattccttaaccatggaaatcagtgatttttcatcgaaattctcctggttcaaagcatcattcactacctcgaaaagttcctctggtttattatacttgaccctcgcgtaaatgtccatagttgtcttactattctcatgccctgccaggtactgaactgtcttagggtcaacgcccgcatagagcagattcgtgatgtaggtatgccgcaacaagtgcggtgttacatcgaaattcagggtatagcgaatcttgggattgttcctctgcgttgttcctaatgtcggcttgacggtatatttgatgctctgtccattcacatatttatagtaagttctctctttcgcagaacgaacaactacatactgccaaactctcgtaaactgagaataggaaagcggctgtccctcactgtccgcaatcacatactccgatatggaattggcttttgcttcccgcaggcagtccaccaggcacttcggaatgggaatgtcccttttagctgcttttgtctttagaacggtagaaatcaccggcctgttatgctccgcgcgccatgcacgtctcacggaaatgtatggtgtggattcatccaggaatacacaatcccattgcaatgcaagaatttcttcccgacgcaagccggaatacaaaccaatcataataaaaagatatggcggaagctctttcaccgtatccaacagaaccgcaacctgttgatctgttaaggcatctttctttttcgatgcttttccgccctttgctgaaattcctacacacggattatcggttatcagctgactgcgctctgccgaataaaacacacacttaatcagcatatttaccgtatcatacagtcctttcgatttttgagacagcggaacaagcgccagacgaatatcatccgcagtcacttcctccatatacatatctcccagagagttgatgacataattcttcatattctgtctgtatccttttatagtggccgtagacacctttgctgactgcatcagcagccatttctcacaatactcggcaaccgtcggatgcttccggcgaaagatgatttcctccacctgtctccggccttccaactgcttttcatataattcttcacaggtggtcgcatataagctgacctgctttccatcggcatctgtaattctggttctgtaatacagtgttccttttcttgtaaccgttccgtactctggaacgctttgttttttcttagccatacaaatcttcctttcctgataatgagtgttcttaaattcacaccttctttttatcagaaagcactaacttaatcaaagatacggattatgaaaaacaaagagcgagacatccttgcctcgctcctgcgttgtttcctgcttttataatgttatgcctgtgctgcatcccactgggcaaatgcaccacccattgttcttaccagctcatccggtctgttgtatttgacctttgcgtaaatgtccatcgtaattttactgctctcatgtcccgccaggtattgaaccgttttcgggtctacggacgaatgaatcagattcgtaatgtatgtatgccgcagctggtgcggcgtcacttcaaaatctaagctgtaaatcacttttccgttatgtgctgccttttcaccgaggaccggcgtaaccgtgtgctttacacgctttccatcctcgtagcgataatagaaacgctccttgacagttcgggtcacaatatactgccagagccgcttgaactgcgtataggataacggatcaccgtctctgttcgacactacatattctgactgtgaattagcttttgtctctttcagacagtccgccaggcaaaccggcaacggaatatttcgatgcgcggctttcgttttcagctcatccagaatcaccggtctgttattttccgtgtgccatgccctgcgtaccgttaaataagggcaatccacatccagatatacagaatcccattttagggcaagaatttcttctcgccgcaatcctgcatacagccctaacatgacaaatacatacggcggaagtccctgaatggcatccagcagtctggcggcctgttcatccgtcaatgcagctttgtccttctgcggaacgcctccacctttggctgtaaggtaaatcgttgggttgttatcaataatcttactttcctttgctgcacggaaaatggatttatacaggataaccactgacttatataccgaagcggacttctcggaaacaggaacaagtgcaagctgaatgtcatccagtgtcacatctgccatccgcatctgtcccagttcttttataatgtgccgtctgacctttgaggtataatctatcagcgtggttgccctcacatgaaccgactgcatcaaaagccatttttcacagtagtctgcaaccgtcggggatttccgacagaatgtatcgttgtcgatctgctctaatgctcccaactctttatcatataattcttccggtgttctcgcataaagggccaccagttttccatctgcgttctgaacccgcgttctataataatctatgccgttaagcgtaactgtaccgtattgtggaattgctctttttctttttgccaattccgtcacctcctaagaatagactccagcgctgtatctatgttttatcagaccattatgatttcgacaaggatacggaccggctcacactccagctctgcgaggtttacgataagttgcgttcttttctgctggctttgctctgtgggtgcattttgcgatatactcctgaaggcccgctgaagtaaagtacacacagccattctgcacatattgcacataagaaataagaccattgttacgggccgcgtccagcgttgcaatgctgatacctaaaatttctgctgcttcttttcgtgtaataagtttttccataaagcatatttcctccaatctgtcaagtttgtcatcgtgtttgttcaaagccacatgaatacgctggcagctgaaactgccagcgcatggtatctgattttgaacaggaagctgcaaacgcttcctatttatataactcagctttcatcacatttgccacgccccctgacgatgggaacacaacaggtctccgttggcgcggctgtcataactccgcagcaccgttcgtatcgtgtgccgcagggttccccccaagtctttggcgggccgtgaggaagtatctttaagcccccatgcagtcatcgcgccgaatctgccacaatccgttttatgaaatcgtagatcgctccgaagcagttctttcatcacctccctgacggctccatcttcgcggcgtttcacattcgctcgtacatgggttatgtacctgttgtgctgtctattcgattgtcaatgtactgatgaaggaggaaaacttgtccttcttattaacactgacaaaaaaggcaaaaaacaggcgcatcaaatgaaattttatcaaaaatattttacaagctgctttaatccacggcggatactgtctcggacacggcttgggtctacaccttctacttcggcaatttcatttaccgccattcccagatagtatcgggcataaattcgctttgcctgtttctctggcagcttcatcacagcggcatagacctgctcctgaaactgtttttcctccagaagcatctccggtgtttgcggcttcaatagcaccgcattttcaatgccattctcgcaatccagagaatactgtgctttataacgatacatctttcgctcatacgcagcctccgcacgttcagctgctcgaatagtctccattacttcctctgtcacatctacaaaaaagtctgttgtataaacatcaggataaagttcccgaaggttaattttcttcattatgtacctccatttcgattcacgggtgattgacgggtgaatcgaatggaggcggagaccaacaccggcagacaaccgggtcatctccgaaaaaatggcaacaaaaaacgccaacttcccataacgggaaatcggcgcaacaaaaatacctactattctgctgatttagatggaacgataatactgatagatagtcatactcccccggaggaggggcaagactttttttagctggtgtaactcatggctattgtgaatgacaaaaattgacacggcggcatcctcctatgtgccgccgtaccagattacagggtgtagggtcgtcgttcattttagatagacgaaaggaaacggcggctctgattttttcaaagccaccgttgcaaagtgcataacaatatagtcgctgtacgatggctttttttcttttgccatcgtgcggcaactttttcacttttcttttatcttaacaggcaatcctcacagaaatgtcacggacatactccatttcgacaaaataacaagctgaaatctcaccaatctgtgagatttcaaattttttgaggaaagccgagaggaaatgcctcctcccggctttcaataggtttatgattatctattgtagcaatctctgtcgttactccgaagtcctcagccgctccaccacagttcccttgttaaagaagtggagaacgatcagcggaataaccgcagccagcagcagataaagcacaccaatgaccagaaccggaaccaatgtaatattcagagtaaagaaccacatggaagggccattcaatgcgctctttagcactgtgactgccaggatcgctgcgactgctccgccgataatgtccgcacctacggcatagtagatgccctcatagaccgtcaagcggcgaagctgcttgccggtcataccgatgctctgcatggtagcaaactcatggcggcgggtgatgatgttggtaataatcatgttggcaaagttaatcagtcctgcaaaggccatgatgcaaccaatcagaccgccgataaccaggatcatgctgcggaccgaatcaagctgctctttcaacagcttggtggaagtataggcaaccgaagtattttcactcacatagctgctcaaaaattcttccatctgcggctgcaaggcttcatccacattgaatccataggtcagcagcgtgggagcgtcatagatttccttaaatacagtgtccggcagatacacaaaaggagcatcagcggcgatgtgcgcctgggcggtggtgcctgtcggcgtttcggtttccgttcccacgaggatcgcttttgcaaggatagtgctggttttgaccagttccccatccttgtagaaggaaatgctctctccaacctgtaactgatcggtcagcggagtgttccttggttcctctgtcagtttgtccatggggcagccaataatgacatattctccggtagccattttctgcgttaaggtttcggcatctttttcgccttcaaaaatacgcatatcagcccagaaattttcggaggcccccatcacattgccaaaatagcgcctttcggtatcagaacttgtgtacaggctatatccctgatagctttgatttacgacgccttcttcctcatgaaacagctctatgccgcttaaatcttcaaacccatagtcaaccaatacatttctatcgtcttttgtatttcggtagagatagcgttcatcctcaactccgggctgtccggcaatcagatccaccgcctgttgtgagagcgtatctttatggtgctgaacgctttccattacattaaatgcggctgagttatagacattaaaatctgttctggtgacacggtttacccacttttcttcatcaaggctttgcgtcacaatgatgatagagttaaacaggacgatgcacagaagcagggaaataatgatgaacgctgaacgccgacgattgcggcccaggttggaaaaggccatacgggacagctttaccccattggttcgcttggcacttctctttttataggcgttctgctcggtgtagcgaatcgcctccagaggagaaatctttgccgccttttttgcaggcttcctggtgctgataaacacggtcaggattgtaaagagagcggcgataacaaaaattagcggcgaggtcgatacggatgtacccaccatagagtattcaaggttaatgatctctgtcacgataggaagcagcacccaaccggcaaagaaaccggcgatcagaccaataggcagtccgatcagcgtgagccagaccgcctgacggttcacaatgcccttgatctgccgtgtggaagtgccaatcgtccgcagcaggccgtattgacgaacatcctgcatcacagaaatatcaaagatattgtagatcagcaggtatccgcacacgacaaacatcaggataaatacaacagcaaacacgatggactctgatgaagtcaatccctgggacatttgattttcagaggcgagaatgaaattgtctgcgcccatatcctctggattgccgccaatggagtaaacgaactcattcaactgctgctgaacattttctttattcttcagcacgacatcggaaaaagtaacgccggacatttcatggtctaccgcataagtgttctggaccacatcggggttttcctttataaactgctctgaaacagtcgcaacgctcacagagtcattgcttgcttcccaccagccggaaagcaccatatcataatgataagttttcccccgcagttcaaattccagcggaaccgctgcgccaatctttggttctacacccagcgccttcagcgccaaatccgtggtggcgatctcattcgctttctccggtgcagctccgtgagtaggcacacagaaggtcagctcctgctgcacactgtccgcataattaatctcaatggaatggctggaagtattgcttgcatagccaatgatgcgccggtgacctgcctgctccacaaaatcgctgtttacaagctgctcgtactgttcctccgtcatatatcctaaagtgccatccgccttgctgcctttctgcatttgcagagagagctggatggaggacgccatattgaacgccagggaagtgatagaggtaaataggaaagcagtcaggataattgccagcagtgcagccagattgcgtaccttattctttttgaaatagcgtttggatagcttggtaattacttcggaattattgttgccaaataaaatgtcattcatagtcccgcccccctttactgcacgatcttaccatcctcgatccgaatgatgcggtcggcaagctgggcgatctcactgttatgggtaatcatcacgagggtctgatggaatttctggcttgtggttttcagaagccccagcacatcggcgctggtcttgctgtccagattgccagtcggttcatcagccaggacgattgcaggctttgacaccaaagcgcgggcaatggctacgcgctgctgctggccgccagaaaggttattgggcatattgttcagcttatcctccagccccagcatctgaacgacttctttcataaacttcttgtctaccttgtttccgtccagctccacaggcagcacgatattttcgtagacattcagcaccggaaccagattgtaattctggaagatgaagccaatctttctcctacggaagatggtaagctgctcatctttcaatgttgagagttcacgtccatccacaataaccttgccagaggtcggcacatccaacccaccaatcatattcagcagtgtagatttaccgctgccggaggttcctacgatggcaacaaattcgcccttttcaatggagagggtcacaccatccaaggctctggtaatgttcggttttgcgccataatatttttttagttcagtcgtttgcaaaatgctcataaagaacaccatcctttctttttgataaaccaattgtaacgaccaaacctcacagaaatgtcatgagccacaaaaaatttctgctaaattcggccccaaatgtcacgaacctgtgacatttcattttttcggggcgtgcctgctctactttcggagcaggaaaacagaaaaggttgagcctttcccaacttccgataccacccagatataaccgccctgcaaggtcacaatctcacgagccagatacaggccaatcccaataccgtccacatcatgcaccgcatcttcccggtaaaaccgcttgaaaatcgttccctggtgctgctctgaaatgccaatgccggtgtcggcaatgtcgatcttcacatacatttcccagccttccaccgacacatggatctgcccgcctgccggggtgtacttcactgcgttatccagaatgttaaacagggcttcgcttgtccattttctatcatggcgtgcatccaaatgctccgggcattccacctgcacatctatttgtttcttttcggcattgagcaaaatcccgcccagggcagcggcaagggtatcataaaccggctgctgtttttgctccagtgaaatgactcctgtttccaggcgggaggttttaatcatggcttgcatgaggaagtccagcttatcaagctggctggcctgggctgtcagaaattccttttgcttctgcgggggaacctcgttttcaagcagcgtgttgttgatcatcttcaagttggcaatcggggtcttgacctgatgggagatgtcagaaatcagctcttgcaggtcagcccgttcctttgcgatgctgtttttattttcctgcatgacctcgtacagtcgccccagccggtagttgattttatagaacaggttttcttcttcaaccgtctgcttgggctgcatattttcggagagcatatcatccatctgaccacaaaaggcatcggagaaccggaccagcttccgacgaatcagcgccacaaagcagatgacgcagagcagcacaaaaagactgaacaggaacacacaccggacagcggttatattctgggtcagcagatgaacagcggtgcagactgcaccaaccgccagcagcaaaagcgttcccaaaaggatgcaggctttgttgatggagagttttcgcatattcatttcgatgcccctccgatccacatatagcccataccgtacaccgtcttgatgtactggcgtccatccgtttcaattttattccgcacccggctgatggccgcagtcagggcgtgttcatccacaaagttcccatcggcatcccacagcttttcaagcagcacctgcctggtcaaaacattctgcggatttttggtcaggattttcaacagccggtattccaacggagtgaacaccagcgccttaccggacagagaagcagtcatctccgagaaattgatggatagtgcgctatcctcataacaatccccgccgccagattgttttgccagccgccccagcaccacggacagctttttttgaaagacgctcataggaaatggcttggtcacatagtcctctgcgcccaactcatatcctttgagcatatcgctctccatatcatttgcggtcaggaagatcaccgccgtatccggccggcgctcttttacctcccggcagaaatcaaagccattcccatctggcaggtttacatccagcacgatcaggtcataatcctgcttagtcagaaagttgctagctgctgattttgtcaatacagagtccacgacatagcccgcagtatacaggttatagcacaaagtattattcaaaagccggtcatcctcgactactaaaattcgcaattgtatcacactccttcattcttagtgtagcatccaaatgtcacagaaatctcacgagaggattatttttttgtatttttgaaacgacggtctgccggtttctccgcatccttgggaatcagccaaatggtagccatcttcacagcaccggggatacgcccaccggcacacagataattgatctgccttggggtaacaccccatttttcacttgcttctttcagcgtcatataatccatatagtttccctccaatatggtttattatatttcctttgctcgaagaatacaagcttgcaaatagggtgcaaagccctgtgccagaagcactatgtggccttgcgccctttgttattctatcctaaaaatactttgccagctgcttcagaccgcgccggatgctgtcacggacacggcttgggtctacaccctccgctgcggcgatctcactcacacgcatacccaggtaataccgggcatagatcctcttggcctgcttctctggcagagccatcacagcggcatagagctgctcccgcagctgcttttcctccagaagcatctccggtgtttgcggcttcaacagcaccgcattttcaatgccattctcgcaatccagagaatactgtgctttataacgatacatctttcgctcatacgcagcctccgcacgttcagctgctcgaatagtctccattactttctctgtcacatctacaaaaaagtctgttgtataaacatcaggataaagttcccgaaggttaattttcttcattatgtacctccatttcgattcacgggtgattgacgggtgaatcgaatgaaggcggagaccgacaccggcagacaaccgggtcatctccgaaaaaatggcaacaaaaaacgccagatttccgtgagggaaaactggcgcgccaagaacagccattattatactgaattacatggaacgataatgccgatgcaatgttatacttgcccggagaaggagcaatgcttttttttaactgatgtagatcatgtgagctttgaaaaagcaaacgagacacggcaaaataacctccaatcggctaccgtgtccctgcaagtcgtcatagaattgtgtaaacgcaaagaaacggcggctctgaaaatcaaagccgccgtttcaaatgggcgtgtcaaattgtctgctctacgacggcttttttcttttgccgtcgtccggcagagtattattcaatatttaattcaatgtttccagtgaaattctcacattcaatgccgatataatttccaccatcaggaagtgtaattgtgtcactataagttccggttgcttcaatcaaagtgactgcttcatcagatccagaaatccagaatacttttgcagtaccttccgtaatctccaaggtgcaatcaatggacagctccttaccggattctctctttatggaagttcctccgaacaaatactctgtacctgaaaagttcgcataatcagccgtataagtccctgtataatcatcaattcctttttctttttccccttgcagtgacgatttccctgtcagttctatggagcccgcagactgaacaatgttattgtaatgattgagaatttcatcttttgaacagccagcaagcataaaacttcccaaaaggacaaatgccaatgctaaaactattttcttcataaaatcatcaccagcctttctttggtgctacctttttggcctttttctttgtttgggttgcttctcgctctttcatgcacaaaatcaagatggcagaaataacgacagcaagcgcaagactgcaagaacaggttccgatattccagttgactgcggtatcatagctacggtagcctaccattccaagacttgcggtaatcggataaaggtttgctaatgtcatatttcctgcggcaaacatccctccatatccatagacaaaagcaatgattacaccgactaaaaagctacctgcccttcgacaagtaagagcgataatcggcagaaccgcaagatataaaaagaaattaaccgcagtaatctgcaaggctgcttttagagctaaggaaatctcaaagccgggaaatcccacaatcatttctgctatgattgtaaacagactgcatatcagcccgaaaataatagacaatacgccgcacacaatcaattttccggtcaacagtttcttaaaagagatcggcacagtcagaatatttttcaatgtgtcatccgtctgctcacgagaaatcatatatccagcaattaggctgatacacatcggaaaaatcatggacatattgtttttgatgacctgttctgtaagataggcaaaatcccaaacggaaccatcattcgccatagaggtaaacaaggtcagcaggacggataggagcatgagtgcaacgcccgcccaaaggatatgataccttttcaatttataaaattctgtttttacaatgcgaaccatgtttattcccccctctgcttatataatctgtcaatcagtaagaacgaaaccaatgccatgatcccaagaatgaatacaacttgaaatgttgaaggaattagccctgtcatttgctccaagtccatttttattccatgagccgccatatctcctgcactccaaaatgtagtcagtggcgtgggcagaagccataacatggttttaggcagtgtgtcaaacaatgccgtagcactcatgttcagaacgctgtaaaagacgcacagcaaaatggaaaaaacataggtcttactgaaaaagacaacaagaacaatcaacgggagtgttcctgccgtaatgaaaattcctgtttcaaccgctaaaaacaatttatagcctattccataaacttctaatgttccaaatccgcaaagaattgttgcaatggtagaagccacacaaaaaacaattccaaaaagaaaaaggacaataatctttgcaagcaccatttgcgtgctggttacgggaattgtacgcagatttttgaatgtatcgttgtcgcgttccataaaaaacagaatagcggcaatcactccgataatgcagggcagtaaaaactggataccatatcccaacaccatgttaaatagtccatcgaaagcatctgcccgatccgtatatcgctccatcatagagggcattgtcatcagataagtcagcgggattggaaacaggaacgcagccaaaataatcagcggaataaatttcttccgttttaatttcaaaaattcgcatttgattagtttaagcaattccttctccccctgtcacacgcttgaagtaatcttcaagactttcttcacaagtatgcacctccgatacctccaatccgttttctacaaaggcagttacaattttccccacaggcagatccaggttgtgcaggcgcagattgtggtcgtcctgtatggagaaatggttttcatggaaattgcgttccaaaattcttgccgcctgtgcagtatcagagagcgtaaaacggatatgcttactgcttttttgctccagctcagcaaggctttcttcttccagcaacgcaccgtggtcgataattccaatatcgtcagccagcaaagaaatctccgaaagaatgtgactggaaatcaaaattgtttttcctcttgcgtcgcaaagctcccgaataaaggagcgtacttctgcaataccgatgggatcgagaccgttgatcggctcatccaaaattaaaagttccggatcgtgcataacggcaagggcgatggcaagccgctgcttcataccaagagaatactgtgaaaagagctttttatctttgtagggcagtcctaccaaatccagagcgtctttgatggcatgattgtttggtacgccccgcagggtagcaaagatacgcaggttctctgtgccggtcaggttgggataaaagccgggggactcgatcagactaccaatacggggcagcaacttcttttcattcccctgtaaagactttccccagattttgacctcaccggaagtaggcttcgttaagcccaacagcattttcatggtagtggtttttccggctccgtttctgcccagcagaccgtaaattctcccacgcttcacatggatatttaagtcaaccacactcttttgtgagccgtattgcttcgtcaggttttttgtttcaatgatataatttgtatccatattcaaaacctcctgttctgcaaggtattctatcatgccaaccttgcattaaccttgccgcaaccttgcattaaccttgcaatttgaaatccagtaaaatgacaaaggctcccgccataaagacgggaacccgcttaactctccaaaggaaaaagcaacataaattcagttccttttcccggcaaactttcaactgttatactcccacccatcttttctacaagctgatggacaatagaaagaccaagaccgcttcctttttcagaccgtcctttgtcacacttatagagccgttcaaaaatgtgtttcaaatcttccttctcaattcccactccattatccgccagcaacagctccatgctgttttccttcttcgatagggaaattttaattttgtctgcatggctatgagcgattacattttgaataaggttattgatgatcctcatatagctgtccatatccaatcttacccggacaggctgttcgggaatatcgatgtcatactcaacctgtttatcctcaaaaatcggtatccagtcaatgaggatatttcttgtcagctctgcggcctcaacgctctggatctccaaagcaaactcgtttgaatttaacttgaaccagtcaaagagtacatcaatatattctttcagatcatgggctttccggcgggcggtttcaatataaccatcccggtcttttcctgtgaccagtcctttgtgtgcagcgtcaagatacccaatcagagtagtaaggggcgttcgcacgtcatgggaaaggctcgtcataagttggcggttggtttcttctgtctgccgtacagttgaaagtctgctttcataggccacaacgatctcgttgatttcataggcaagaggtgctgtcagttcatttgttgcagatagaatacgccggttgccatttccgtttttcacatcaaccagcacatcggtcatttctgctatttgtttttttacacgccgaacgagaacgatggaagtcaatacagccccaacagcaatcacaatggacaagaatacaatgatttccatactgactacacctccttattaaaccggtagccaatccctttgaccgtttgtatatactttgggcttgaaggattgacttctaattttttacgaagccgactgataatcgccataatgttactgtcatcatagaaatattcttcgccccatacttcctcataaatctgctgtttggtcaaaattttcccttgatgttttgcacagtacaggagcaaatcaaattcctttgggggcagttcaaaagtgccgtttgatgtagtaacagaacgattttcaaggtcaatctgcaatccgtcaaaatttagcttttgtatggctccagcttgctgattaaaacgggtgtagcggcgaataagagacgcaatacgggcaatcagttcatccatatcaaacggttttgtaagataatcgtccgctccggctcgtaagccccgtactttagaaatgctgtcatttttagatgtgaacatcaaaatcggcagactgttctctttgcggatttcctccagcgtttcaaagccatccataccaggcatcatcacatccagcaccacaagctgatactcctgctctcttaatttttgtaagccctcttttccggtattacaaaaatcagcttctatgttttctgcttgtacgctacgtttaatcaaagcgcacagttctctgtcatcatctataatcaggattttattcatggtgcaaccccttcccttgttttgtccttccgtcaatcggcttttctgcgttctttgggatcagccaaacaccagccatctttacagcgccggggatacgcccagcagcgcaatagtaatttactctacgaggtgtcacgccccatttttcggcggcctcttttagtgtcatataatccattatgcacctccacagagtacattatagttctttgtctcgaacaatacaagtttatctgttccaacgcaaacgtttctttgttgtatagttcttcaggtgtttttgcgtagatagctacgagcttaccattcgcgtctttgattctggtcctataatataggacacgttcagctgcccgaatagtctccattacttcctctgtcacatctaccaaaaagtctgttgtataaacatcaggataaagctcccgaaggttaattttcttcattatgtacctccatttcgattcacgggtgattgacgggtgaatcgaatggaggcggagaccgacacctgcagacaaccgggtcatctccgaaaaaatggcaacaaaaaacgccagatttccgtgagggaaaactggcgcgccaagaacagccattattatactgaattacatggaacgataatgccgatgcaatgttatacttgcccggaggaggagcaatgctttttttaactgatgtagatcatgtgagctttgaaaaagcaaacgagacgtggcaaaataacctccaatcggctaccgtgtccctgcaagtcgtcataggtttgtgcaaacgcaaagaaacggcggctctgaaaatcaaagccgccgtttcataggcgcgtggaaatgtgtctgctgtacgacggcttttttcttttgccgtcgtccggcagattaacatataaaactataattcgttgatggttgcagtaattggcatattgcgaattctctttgcaggagcataaacggacacaatagcagatatgaagataaaggcaacgacaattccaaaccacaggataggaaatctccactcaattccaaaataatgtgtaattagacgattatataaaaatcgactaagcgggagtccaatgccacatccaactattaaaccagaaattgcataggtgtatgcttccgcagaaatcattcgtttaagctgcctattatccataccaacagctcgcattgcaccatactgcttaattcgtgcagatacactcatagaaatactattgacgatattaaacagcgaaataactccgataatagctaagaagccataacaaacaattcgtgcagcccaatatgtagcattattttgtttattgccttcacgctgatctgtaatgataatatcatcgttttcaagacttctaatttctgctattgtttcttcagtagcgtttgaatctaactgaattccaataagcccatactttgtaccgcccatgatacggtcaaatgtttcctgtgagcaaataataatcaaatcatctccgaataacccttgtgatagagcgcaagtaatctcaacttcttcgcctgcaaactggatggtatcaccgatgtgcaaggaattgtttctattaaatacggttgccactttgttactgttcccgtaaactgtatctaatgatccctgagcaatactaccttttgagtaatctagaagtgtatcatcataagaaacaatattgatatggtctattcctgctcttgaagatgttgcaggaatgttttctacatagctacttccataagcatttgcaaccccatctatttttttgatttcatcgaccaagctgcgctcaatatccattttatttgcataactggataatgctatatcggctgatgtgacactcaacgatggaacaagttgctttgcaaaatctaaaattacagaaaaagaaaaaaccagcataatagtcagtgcaaaggaagccgtcatcagaaaccagtttttctttttttcaaccgcatgatgtatgccaagtgaattatcaatttttcctaagctaaacttgatagcgtgtttaacagaagatttattatctacattgccagaaaccgcagatatgggtgaaactttagcagcccgctttgctggggattgtgctgctaaaaatactgttaccactccaacaactacgccactgataagtccaacagggctgatctgaaagactggcgttgtagaaaattctccaccaattccataatgaagtgtggcgcaaataatccaactaattattgttccaaaaaacactccaataggtaccgcggttttacaccagttcaatgcctccaaacggacaaagcggataatttgttgacgacttgcaccaatgcaacgcaacattccaaaaaattgagttcgttgcgcaatgatgctattcatactgccagaaatcatcaatattcctgccaacaacactaaaacaaatagaattgctgccaatccgtacatactctgcatcgctgtattgttgctttgcccagccatgcccataacgccggtattttcagaaatactcccatcggataattggtactgtgtctgtagttctgttattgcatttgccgctttcgctgcactttcaaactgcacataataagtcaactcattgtttgttactccgttttgtgccataacagaagtaaatgcactttgtgtcagataagagcctatcaaataagtctgatttttataatagctttcatcatctgtgccaaagccagagattgtaaatgtccgatctccagcaggggtatgtaaggttacactatccccaagctgtactcctaaagcagttacagaattaggtgtaagcataacttcctcatcatttgccggaaatgttccttctacaattccatttgaaatctgagtaatatagacttcatcggtgccatacaaaacagttcgtttttcgttgactcggtacggttgttctccttcaaaattaaattgagaagctacaccaactgctgtaacatctgaacgattactgatttcatccgcattgttctgtgaaatattttttattgcaatgtgccagtttccatggttacttatcataaaatcgctttctgttcgtatcatcatgtcagcaacactgaaaatagctgtgacaagaaacaccgaaatgataatacacaagacagtcatacaattttgccgcttgcgcacctttgcggagatgggaatgagactaagatagcttttcattcacggcacctcccaaaatcagtcaaagtgccatccgatacctgtaatacccggtctgccgtttgtgcaatactgcggttgtgggtaatcataatgatggtctgctcgtattttttcgatgtttctttgagcaatgctatgacctcactgctgttttgtgagtccaaatttcctgttggctcgtctgccagaatcagagaaggacgggtaatcaatgcgcggccaatcgccactctctgctgttgaccgccggaaagctgactgggtaaatgattacgacgatctttcaaattcaaaaccgtcagcagttcctccaaatatctcttatccggcttttgataatccaacaacagcggaaaaataatattttgttccaccgtcaactccgggataaggttaaacgcctgaaagataaagccgatatttctccggcggaaaacggtcagctttcgatcgttcatggcaaaaatgtccttgccgtcaatcagaaccttgccagatgttggcgtgtccaaagcaccgatcatattcagcagtgtacttttaccagaaccggattccccgacgattgccacatactcgccctttggaacagaaaagctgacatcctttaatgccttgacagcggtttctccattgccataggtcttactgatatttttgacttctaataagttcatagtgtaaacacctctttctgaatgattttgcgatataggcaggctgtctttgtttgtcctgcctatgtgtgagagaatagcacctgaatcttactgtaagcctacagccagcctacaattttgtaggaatcagaaaattcattgtgaaagttgtcccgatacctaattcgctgtcaacctcaatggtgccgttatgtgcttcaacgattgcctttgccaaaggtaatcccagtccaatcccttgcttgtccttagaaaaacgactgcgataaaaccgcttgaagatgtgatgtatatcctctgggtggatgccgcatccattatccgttatcacaatttggacaccagacggcaactccttccacgcaacacgaattgttgcaccactttctgtatggtcaaacgcatttttcacaatattgtcgattgcctcattcaaccaatcacgatcacaaaaaagagaaagatgatccgagccagacagaatgatttctttcttttcctgtctggctctatatgcaaaatgcagttcaatatcccgcatcatatctgcaacattttctgcgttcttttccaagacaatggctccggcatccaatcttgtaatcttgagcagactttgcaccagtgtttcgatacggtcaagttcctgctcagacaaacccgcaaattctttcacggaggacacttctatatcctcgtcttgaaggagtccgttataaatattgagtgctgccagcggtgttttcagttggtgtgaaatgtcggagattgtatttttcaaaaactctttctctcgcaactcgttatctgcatgggcatttaacactgccgctaaagaattgatggaatgaaacagtcgatacaattcgccctcattgtcacattcaatacgggcattgcgatcaccatcaagatacgcattgatttgtaatatcgcctgctccatgatctgattttgccgattaaaatatacaaagcagactgcccatacagcaccgccagccaatagaaaaaggattagcaataacagagaaagccggcgatatgacagccatagaaaaacctcggctaagagaaatgtaacccccaaaaccagtgaaagcgaaagaaatagatttttgatttctttatttgccagtatcttcattctgcacctcacccgataatattccatttatatcccatacctcgaacagtcaggagcatttgtggttcacttggattatcctcgatcttcatacgaagccgacgcatatagaccgtaagggtactactgtcgatataattcccgtcgcaatcccatagcttatctaaaatttgtccctttgtcagcaccatgcttgggtttctcataaacaagcacagtagcttgtattccgcggcagtcaaatccaacagctccccatttttgaaaacctgtccttgcagcaaaagaactttgatgccattcgactgcaattctgtgtctgctgcttgaaaagaatttgcacgtcgaagtaaggcgttaatccttgaaacgagaacccccagtttgaacggttttgtgatatagtcatcacctccaatatccagccccataataatacttgtttcctcatccgaagccgtcagaaaaataattggcacctttgatgtaagtcgaactcttttgcaaaattcaaagccagacccatctggcagagatacgtccaacaccaacaaatcatattttccgtctgtccacaattcctccgcttctttgagcgttctggcgatatttaattcaaatccctgctttttgaaagcaaaagaaagcccgttaatcaggcttagatcatcttcaagaagtaatatattactcatacttttctgcctttccttgttttgttcttccgtcaatcggcttttctgcgttctttgggatcagccaaacacccgccatctttacagcgccggggatacgcccagcagcacaatagtaatttactctacgaggtgtcacgccccatttttcggcggcctcttttagtgtcatataatccattatgcacctccacagagtacattatagttctttgtctcgaacaatacaagtttatctgttccaacgcaagcgtttctttgttgtatagttcttcaggtgtttttgcgtagatagctacgagcttaccattcgcgtctttgattctggtcctataatataggacacctcttttcataactgtgccatatgtactgatgaaggaggaaaacttgtccttcttattaacactgacaaaaaaagcaaaaaacaggcgcatcaaatgaaactttatcaaaaatactttccgagctgctttaaacctcgccggatgctgtcacggacacggcttgggtctacaccttctacttcagcaatttcatttaccgtcattcccaggtagtatctggcataaatcctctttgcctgtttttccggcagcttcatcacagcagcatagatctgctcctgaaactgtttttcctccagaaccatctccggtgtttgcggcttcaacaacaccgcattttcaatgccattctcgcaatccaaagaatactgtgctttataacgatacatctttcgctcatacgcagcctccgcacgttcagctgcccgaatagtctccattacttcctctgtcacatctacaaaaaagtctgttgtataaacatcaggataaagctcccgaaggttaattttcttcattatgtacctccatttcgattcacgggtgattgacgggtgaatcgaatggaggtggggaacggcagcgacgtacttcgggaactttcccgaaaaatcgacagcaaaaagcgccagctccacacaatgggaaactggcgcaacaaaaataaccataattcttctgttttaattggaatgataatgccgatagataatcatatctccccagaggaggggcaaggctttttttaattggtgcagctcatgggtggtatgaatgacaaaaattgacatggcggtatcctcctatataccgccctcttgattgcatgagcatcgttggaaaagcaaaaagaaacagcggccttgatctactcataaccgccgtatcagctatgtgggtttgcatgggaaatgatctgcccgtcagcggtttttttcttttccccgctgtgggggcagatgtttcttaattgatttaccacaagcataaactacaaatgttacacaaatgtccgaggcgtctttgatttcgacagaaaaacaggctgaattgttacaaagctcggacatttcaaaaatttctttgagaaatgacgaaaaaagcggggcagcacacgccgccccgccgatcccatacggttattccattgcccgcatttgttcaatcagagattgttttttctgtctgcggattgtccatacagacaagatcagctccattccgaacaataccagaatgaacagccccatttccaaaaccgggaattgataaggcactacatttccggcaaaagcacctacactcatttttctgcaagcaaagatggaagccggaagcccaacgatcagcgttgccaatgttgcaaagagcgcatagcacagcccctcacagatgttcattttacatagctgtttttgtgttaggccgatagaacgcagaatactgttttcctgctttcgggcgatctggttagagagtgtcgtgttaatcaggttgataacgccaaagagaaataccagccatgacagtacctccatactgccaaacgcaaaagaatttgtcatttcttcatattcaatcactgtattgatttcatctaaggcaatattactatggctggcaacaatatttttcaattcagctcccacatagtccgtttttttagggtcatttacaatgctccatgaatagtcaaaagaggtgatttccgggtgcagttcgtggaacaacgcttctggtgcaaaaagagttgccccatctaagtgcatcctgccatgtcctgaatatacctttgcaggagcgtataaccccgatatggtaacagaaacggatggctgttcttctcccaaagaaatctcaaccgttgaaccaacacccatatcctcattctgctttagcacattatagtcaattacaatactacgggaatctgttggcatggttccctctgtcagagccgcttcaactaccgcataattctggtcggtcagcatatcgcacataccaccagcttgatgaatctctgttttataagttgcatggagagattgcctgcttggaattatatctgtaacgccatcaatagataagatttcctgctttaattcctcattcaatggatttcccgctgccataaccttttcttctgtcatttcagaatccaaataaattttatagtcgccgtctgggaaaaactgtcttgcaagcgcctctggtgagcgcagcaaaacaatggaggataccacaagcaggataattccgcccaaactcaatgaggctacaatagcaacggtcttttttcggtcacgcctaaaatttgcaattcccattgaaacaggattgagcttgatattctttttccggctgcggatgtccttttgcgccggggtaaaatggacggcttcaatgggggaaatccctgccgcaattttcaccggcttacggatggaaacagataccatgatccaactgcttataagcgttaaaataaccgttgccacataggaaacagcgttaaaacccttggaaaacaggaggaaaccgccgcatacgcccagcactgtgccaatcagaatcccgatactgccgagttttcgtccctcgttctttacaatccgcttgatttgctttggtgtcgcaccaatcgtccgaagctgcccgtagctttggattttgtcattgatggagatacggaagatactctggatcacaatatagccgccaatcagaacaagggcaatcacacctgccatcagtgcaaaatcaaaggatttagaagcataggcaaaatacttactgttcattttgggcataggaagctgatattcctctgcaatctccctgcaataagaggtcatcagttcctcacccaactgatcgctgtttttgaaatgggcataggcgcgatagccagccgggtcaaacccattccattctgttagggcagctttggaaagaatgatcgcgcaggtattcgcttccttttcatttacactgttcataatgccggtaacgacataatcaccatgaaaactctcggtgtctaaggtcacagtgtccccgatcttggcattgtttccataggtggaaagaaagtatttgcttacgacaatttcatttgctttttcaggaacccggccctctaataactccatctgcgccttggtaatctccatcatttgtgtgtcacaatacacataggacgcatgatagccctgttctgaaagttcctcaccgagcatatagtagccgcctacacgctcaaactccggcagtcctttcagggtttcaatgtcgttttcctccacgcccagccagaccgcctcataagtatcgacaacctgattgcgctgcatttgtgtcagggaggtagacacaattcccgtaaagcagattagaaacgccgccagtgcaacggcaatcaccaccatcagattccggcgcttctcgctttgcaaacttttctttgccagcttctttgtaatggcgctggtatcattctcaaaaggccatgtcatagcctgccacctccttactccacaatcttgccgtcctcaatgcggacaatccgatctgcaaggcgggcaatgtcgttgttgtgggtaatcatcacaacagtttgccggaactctgcactggtgcgcttgataagccccagcacctcggcgctggtcttgctatcaaggttgccggttggctcgtcggccagaacaatagccggtttggtaatcaaggcgcgggcgatagccacacgctgctgctggccgccggaaagattgttcggcatatttttcagtttatcttccagccccagcaggtgaacgatctcgtccaaaaacttctgatccaccgtgtccccgtccagctccaccggcaggacgatgttctcatacacattcaggataggaacaaggttatagttctggaagataaagccgatgttgcggcggcggaagatggtaagctgttcgtcgttcattttcgacagttctttgtcccggacaatcacattgccggaagtaggggtgtccagcccgcccatcatgtgaagcagggtggacttgccgctgccggaggttcccacaacggccacaaattcgccgtcatttacagagaagttcacgccgtcaagggcgcgggtgatattcggctctgtaccgtaatactttttcaggtcgatagtctgtaaaattctcataaaattcaatcctttctttgtttgttgtaaatgcggaacgctgctgcgccggtggccgccaactgtaccagaatcagcacagcgaacagtccgaagctctcatagtagaacagttcatcccaaaacaggagaacatcgcagagggcagtcaaggcaaccgtccagcggatgtgctgggccagcctttgccagaacgccagcacaagggcaacgggcgggacgatcagcagcgccagattcaaaatcatggtcggggtcagttccattgcaacgcctcctcacttttgttgataaggtcattgtaaaacccaaatgtctgcgaaatgttacagcggccaaaaaatttcatcgaaaatcggggtgaaatgttacaacgctcggacatttcaaaattattattcaactacccttaatcgagctacaatacttgtttttctaaaatagcgaaacgaaacatgaggaactataatcgccacaacgcaaataacaattccctctaatatcaacgggaaaatcgtaggctgtattgtaaacagccataagtcaggttgattaaagaaagtaggaagaattgtatttgcaacaataagagagagaggtaaacccattacacaaatcagaaatgcgtaaaacaatccctccaatacggtcaatttgttaatttgttttttcgtcattccgatgctctctaatgtagcaaattcccgttgccggtttataatgcccgttataatgatgttggaaaaattcacaagcccgatacttcctaatagaaacccaataaggccacctatgataaaaatagtttgttttaatccattcatagtttgtgccaatgtttcagacgatgcatattcaacggtaggcaaagaattgatgtactcggtcgctggcaaaaagtgttctttttccacatcaaacacataactcattatggctggattgttatacaattccacaaacatctcattactcatatagaaaataggacaatcgccgccaacatcagtgtagccaacattcttacccggagattctaccaatgaaaaatcaaccactgcacgcgcaattaccgaaaccgttttataaggcaatccatctttgtaaatggtaacttcctgattgagcggacaaagaaattcaggagattcatttgggttgatcgctgaaatttctataacatagtttccactttccaaatatgaggttagttgctgtatatctgtttctccctcaatgaaattcaatttaggaagtattgatttttctaccccgtaaatattgcaaagaggtcgataatcaacaccgagttttactggataagttctgccatcaaccataccacttcgtataaggtgattatcttctgtgtattcgtctaatacttccgtgaccaaactaccataatcataagtaacactgacatcatccaaagtgtttttataaattcgacttccgttcagcacaggaatattattttcaatatcagatatgatttcattactaacagaatcatctttaaatcgaaaaccttgcacattagaaaatgtgtttgggcttgccacaacaaaatcaaatgaggtaacagaagatacatattttttaacatcaacactatttccgattgcgattgcactgtttaggagaataatgcagagtatcatggataagacgataaatatggtacgctttgaatttcttcttaaatttctccatgccatttctattattctattcttaaacgaaagacgattcttgttggcactatgataattgtctttttcatagtatctggttgcctcaatgggcgaaatcgtagctgcaattttgaatggtttctttatgctcacccaaacagtaatcgcactaaatatcccggcaacgacaaaaataataggattaaaactcaagttcacagaaagattgtgatactcgcctttcataaaattaagaatccacggaagcataagtattcctactatatatcctaaaatcaacccaatagatataccaattatagacagccaaaatgcttgcttataaacaattcgcttgatttgcttctccgttgttccgattgttcttaataagccatatttctttatttcttgaacaacagaaatctcaaaaatattgcgaatgagcaaatagcccgttattacaaaaatcataataaaaaacagggctgctattatggcaatccaatttacagatgtaccagtggatgggctggttcccctaatttgcaaaatagttgtctgtatagactggatcgctccaacacataaagtcgttacagaagtaaaaagcattgatgttaaaacgattgctattacagcaacaatatttcgtaatttgttggctttgaagcttctttgcgccagcttctttgtaatggcgctggtgtcattttcaaaaggccatgtcatagttgtatcacctccatatttgataagggtattgtaaaacctaaatgtccgcgaaatgttacagcggccaaaaaatttcattgaaaatcggggtgaaatgttacagcgctcggacatttcaaaaatttttttgagaaatggcgaaaaaagcggggcagcactcgccgccccgccgattccatacgattatactgtcactttgatttgttcaacaagagatttcattttaacgaaactttagttacattgattcactcaatcgctttaatacgctctactacagactgcttcgctaaaatgtgtctttgatacactgttactactatatgaaccacaaaaacaagcacgaaatacaggagtagaaacggccacgggaagcgataggaaatataggataatccgggtatttctgcgatcttgttgcataaaaggaaccccagcggtatgcctaccacacaactccctattaaactacccaaaaaataaatcctgttttctgcactctgtgtttgataaatttgtactttcgtcataccagcggcctctaacagcgcatagtcatggcggcgtataacggtgtttgtaatgcaagtattaagcaaattgacaaaagcaaacaaacatatcaacactatcactgctgtaacaacaattttggcgttataaaaatacgcctgatattcagataaatcatccgcaaatatggaagtatttatacggttatccgaagccaccagtgccttaatttcctcaacagcctgtttcgtttgcatatcttcagtacaaatgtaccatgccagatcacaatttatttctgctaaaaagtccagatattcaggggtcgtatagaatacgctacctttgtccttattttcgatgaaaccacatactgaaaaatcaatttcttttgtagacattcccgtatttactgatgcggaaaaatgatctcccaaactcagggaaagacctgttttttcatagtaaggagaggcacgatttatcacaatcggaatagtgctgtttgtatttggagaataaggcatatcaccctcaaccagttgggtttcaaaactggttgtgccgacaatactattgatggatagttcatatctattctcaggttgaccgggaacgacgatctcacaatctaattttttggatggataaatttctgttacaccagagatattttcaatctgcgctttcaattcctccgtaaaaggactatctttcatcagttcaagagtagcgttttcggcagctgttgagttcagtttaagataaatgctgctgttttcataatacggttgccggacaagctcttttatatcaatagccgaaactaccgaaaagactacaaatacaaggactccgctcaacacaagggatagcagcgtataaaatgcctttttacggttactgaaaaagtatttttttgccaaaccattaggattgatacgactgctttttttgaaaattttagctgattttatttcctctgtcctcaatgccgccataggggataaagacgcagccagttttgccggtgtacggaatgaccaaaaaacaatgaaccatacaaaagcaccggaaagcaatgtgcaggccacactgggcaccaaatataatttcaagggtaatacacaattaaaaagaaaacccaatagcaaaccgcctaaaatatacttccaagataactgttttcgctcgttatgaatgactgctttgatctgtcggtaggtcgctcccacagtcctcaactgtgcaaattctcgtgtgcgctgtaatatggaaatatacatgatatttttaatagcgattcctgctgtgagtagcagaacaatagcaatccccaaaattacactaagtatttcctgtgtgttatcgacacgagagattatctgtgtatctattgtggcattacaaagtaagatagtcgaaaatgctaacaatagagaggcaataaacatgataatccctgcgaggaaatttcgttgtttatttgcggatagactttgcgtcgctaattttttctccactttgtgagtatcattttcaaaaggccatgtcatagcctgccacctccttactccacaatctttccgtcctcaatgcggacaatccgatctgcaaggcgggcaatgtcgtcattgtgcgtaatcatcacaacagtttgccggaactctgcactggtgcgcttgataagccccagcacctcggcgctggtcttgctgtcaaggttgccggtcggctcgtcggccagcacaatagccggtttggtaatcaaggcgcgggcgatagccacacgctgctgctgtccgccggaaagattgttcggcatgtttttcagtttatcttccagccccagcagatgaacgatctcgtccaaaaacttctgatccaccgtgtccccgtccagctccaccggcaggacgatgttctcatacacattcaggatcggaacaaggttatagttctggaagataaagccgatgttgcggcggcggaagatggtgagctgttcgtcgttcattttcgacagctctttgtcccggacaatcacggttccgctggtgggagtgtccagcccgcccatcatgtgaagcagggtggacttgccgctgccggaggttcccacaacggccacaaactcaccgtcatttacggagaagttcacgccgtcaagggcgcgggtgatattcggctttgtgccgtaatactttttcaggtcgatagtctgtaaaatgctcatactcaaaactcctttcaaggctttctgcctgctgataagggtattgtaaaacccaaatgtccgcgaaatgttacagcggcccaaaaatttcattgaaaatcggggtgaaatgttacaacgctcggacatttcaaaaaatttacggcgggcagccggaaatggccgtccgccgtagctcatgatctgttctaaaaccaattcgccttttgatttctaaattgaggagtatcgctttcttgataaggattgtaggtattacggttacacccaaactcttttaatgattttattttattgtcctctgtccattcaatcaaagaaataccgtcaaattcctctatatccccattgttcattccatttttgaaataccactctacaatcgtttgattttctttatggaaaaattgcttgatttcccaaactaccacctttccacgggtattccactcctgaaaccaatgttttactgttttacgattgctatactggggacaccaactttctgtatagagtacatcttccgcaaaaatatcatcaatgcccatatctttctgataaagccacatatcaaaccacagtcggattattttttctcgttcattcataatagaaacacctcgcttgtttactttcattttgtaggcagcataatggaaaattccgaacccttgcccggctccgaaaccactttgatatagccgccttgccgcgttacgatctcgcgggccagatacaggccaatgcccacgccctgctgttcgtgtacttcttcctcacgatagaagcgccggaagatggcagcctgattgctttcggaaatgcccttgccggtgtcggtcactttgacctccacatacatttcccacagcaccactgacacggcgattttcccgcctgccggggtgtacttcactgcattgtccagcaggttaaagagggcttcggatgtccacttgctgtcatggaaaacggtcaaatcctccgggcagtccacggacacagcgatttcctttttctccgctgcatacacaatcccactcatggcctgcgccacggtatcaaagaggcgacccggtttcttatccaactggatcacgcccgtttccagccgtgaggttttcacaagggcctgaaagagaaagtccagcttatccgtctggctgcggattccccggataaagtcggtgcgctccgcctcggtcatgggcttttccagcagggtgtccgtcgccattttcagattgcttaccggcgttttcacctgatgggaaatatccgatacaagggtctgtaactcctgccgttcctcgtccacccggcggcggttctcctgcatgatctggtaaagccttgccagccggtgtccgattctggcaagctgggtttcgctgtcctccgggcgctggggtgcttcattcccggcgatcatgtggtctaaggtctggcacaggtcagcggtaaactgcgacagccgctttccaaacgcctgtgtcagtacaaaaatccccacaagggcgcacagcagcagcgccccgcccgtcagcagcaccgcaatctgttttgtcacaagaaacagggctatggtgatcccggacatggagaggacaagtcccattgccacccagccaaacagccgctttaccgaaaggttctgaaacttcattttgcctcgcctcccgtccattgatagcccatgccgtaaacggtcttgatgtagggcgcgccgccgtcggcttcaatcttgctgcgaatccggctgatggaggttgtcagtgtgtgttcgtccacaaacctttcgtctatatcccacagcttttccaaaagctgcccacgggtcagcacttgccggggatttttacggaacaggttcagcattttgtattccatcggggatagggtcaggggcttgccgtttaaggaagctgtctgctcggagaagtccagaaacagccgcccgtcgtcgtaaatgtccttggccggtttgtggtgttccagcatggcgaacatggctttgatttttcgctgcaaggccccgatcacaaagggctttgtgatgtagtccaccgcgcccacctcatagccccgtatctggtcgctctcctgatcgttggcggtcaggaaaatcacgatggtgtccgggtgctggggctttatcagtttgcacagctcaaaaccatttccatccggcaggttgatgtccagcagcaccaaatcaaattcccgctggcggatggcgtcggctgcggttctggcatttagggcagaagtcacgccgtagccgtccgcggtcaggttataggccaacatcttattcaaaaaactgtcgtcctcgacaattaaaatctgcttcatatcctcacttcctttgctttttgcagatagtataacaggcaaatgtccgcgaaatgttacagcggacggattttttcaaaaaatctatcagcaaaatatagctctattaaaaagcagcaccaaagaagatattttcatattcctcccggtgctgtttatatattatttcagctcatccttattatcttcttgtttctttttatcccgatatttccgtatgagtttattacggatggaaacgccaacaccaatcaaaagcacaactgccaaaattgtgaaatccatacaatcacctcacatttccttattcttcataacccgaatggacaagaagattgaaaccgtatacatcacgacaatagcaaaaaccgaaagcaaaacaagaagtatcggagaagattcaacgactgaaataattgagttcccgatagctggcattttagagagaagaagtaaagtaaccaaaaaaccggccactggaatatacataaatacccgtcctttgattgaaccgtacttgtaatatcccggaatctggaacacagtatagagtgcaaataagaatactcctgcaatagcggcggtcacaatgtcaaatgcgccaactgtttcacccagcactttcaagacaagcggctgtgcaatcaaagaaataatcagggaaagaagccccattgcaaggacgaaaacatagcgtccgatcacaagctcgcttttacgaacaggtaaaataccaaacagacgatccatactgtttttttctgtgatggaaaaggtatatcccgtcgtcatggcaataaagcacatagcaaatgatacccctgtcagcaaagaacgattgattgcggcaaacacaatcggcagaagcagggtaaagcaaatcgtcttaaaatatggttttaccaatgcaatatctaattttgtagatttcaaaatattactcataatcgtcacctttcttgcttgtaaacactacaatctcatcaatggtggcaggctcaacggtcaggttggagaaatcgttaatatcttcggttttcatcagagcctcaaatcccgtagggaatgtacgaataccatccgccttatttttcagatcatcggacagttcctcaattccaccttttacaatgcggaacatatctacaaaatcatctttgctgccagtaaagtacagctcgccatagctgatgtaggtaatataatcggctgcacgctccaaatcgcctgtgatatgggtggagaacaaaacactatgctcgccatcttcaatatactctgaaagaattttcaaaagttcatctctggaaaccggatcaagtccactggtcggctcgtcgaggatcagcagtttggcgtcgtatgaaaacgcacaggcaagcattaacttcatctgcatacctttggaaagttcttttacctttttggttggtgcaatgtgaaatttccgtaacatatccgcaaatttctggctgtcccaatttggataaaataccgaaatggatttttcaacctgcgacactttccaatcatcactgaaataatttgtatcgaaaacaacgcccagctctgattttactttttgttcttctgcgatattatccagccccatcactttgactgtgccgccggtgcgcttgagcatattcaaaatcagtttgattgtcgttgttttgccagaaccattcgggccgatcaagcccataatatatccctttggcaaagtaaagctgatattgtgaagctgaaaagaatcaaaagattttgaaagattcgttacctctaaataattagtcatctgtttttacctccgttaaaatgtccaaaaggcgatgtaattcctctgtggatagatttgccattcttgcagcttttattgcttcggtaagattgttttctactttgcaaataagctgctccttaatcagttctgaaccagatcccattacgaaacatccgcgcccctgcacatttttaacaaagccctcttgctctaattctgtgtatgcctttgtcactgttaagacgctgatctttaagtctttggcaagtgttctaagggagggcaaagtttcttcggcttgaagttcgcccgataaaatagccgccttgatctgctgtttaatctgctcgtatatggggacgccagatacatttgaaataatcagtttcattgctgcatcctccgtgtgttttaactgttatgctgttgtgtataacagtataacacatggaacttcaaaaaagcaacatagtttaagaaaagttcttaatagcaaaatagaccatcaaggtcacagatgaaagtattctatattttcaaaatcagcataatcaggcctattaactggcataataaggttattccgaaaagtaaaacggaacgatacaatattattgaggtgaacgattatgccgattgatgatttaactgctttagggcaaaaaatgcgggaagcccgaaagaataaagaactgacacaacaggaactttctgatctgagccatgtttctgtaaagcaaatcgccaatatcgaaaaagggaaaatgaatccttcctatttgattttgagagcattggcaaaggtcctgcacatctctttagatacgcttataaatccagatatttctctggaagatgaaggtgtcaatcagatgaaaatgctttattccagctgtccgccagaaatgcgtgacaccctgctgcatcacacccagaaaacggtgagggaactgacagagttgtccgaaaaatttgaaacgaattgagccagtgagtgaaatttaacgattctctcactggttcttttcattttcggagaaaagaggcaagcaatgcctgtgttaatacacacaggctcgcagagaagaaaatccctttgtgattttcctctctgcttgcttgttgagggcagcgcccccaagcccctttgaacacagaatttcgttctgtggctgcgcggtctccgttccactccggtcggcactaagcggacatcccccggatgtccagtgcctgcgaacgcttttgaccaggaccagcttaccgctggccgtggtctttttctttttcaacatcctgttctacctccattttcagcacccgatccacattggcctttgtcgttaaaagctcccgcatttcctcacgggaacgccggtactcggcataggtctttttcttttcttccagcaattttgcgtactctgtctgcaactctttgaccttgggcagcttcttgacgcccatctcatcaaaggcattcttagcagcctggtggagcagaatttcttcctcatgtttttcccggaatttcttagagtagcccgccttgcggtatgccacatagacctcacgggtcttggcataatttacgatgtgagtacgcagaacagcgatctctgccatgcgcttttcagccgctttgatctgcgccgaaagctcattgtgatgtgccgtggcagccgcagccttttcttccaaaaccgcatactccagcaaattgttctctgacaggtaattcatggtctgcgccatttgcttcagattaaaaacttttgcccatcgcgcatagccagcaccttttccagcctgcaattttgcctgaatgtccaccagcagattgacctttggcggctctgcctgtgcgactgttttctttcgcggggtatgtgctttcttccccaaaagaactgcccgcaaatcttccaatccatatccttcgcccagactgtccatgcgggcggctttttcccaaccaaagagcttcagtcgatacgattttccgcgctttgatacctcacagccggactcttgcagcaacttcagcagttcttcaaagtcagcgggactttgtgataatgcgttgtcaatcgccacacgaagcagctctcggtgagagggctttgcctgatcgcccagccatttgttataactctttccgtgaggtttcggattctctacaatggacagttcattctcaatacagatggtgtcacttagccggcgaaccgccttggtgctgccccaaaagtttcggaatttccggtcatattctaagctgactgatgaccagataatgtgattatgaatgtgcgacttgtctatgtgagtgcagaccacaaaggcatgattgcctttggtaaaacgccttgcaaattctacgcccagccggtttgcttcttccggggtaatctcaccggggcggcaggactggcgtacatgataggcaatcacatcatctgtgccacgcactcgtcctgtagtggcaatgtactgccgctttgccagaaggaactctgcatccgcagtccgactgtcacacgcatagccggtaatgagcctgccattatctgttttctgtggatttactacataatcgatgatgtcactgatcgcccgactttctgtgcggtctttgccaacatgaagcggcatgattcttgtggttgccataatgcttcctcctctccaaacacaaaagctgccacccaacgaatctttatcgtcgaagtgacagctttctgtcattatgcacattttatgttcttttactattcaaaaattcaaccagctcatagactgtcgttaccggattactgtctcggcagatcacagcaacctgatctctggttaatctctccactcgttcttttgcgtactgaatagcttctggctggtgttcctgcaattcttcaaaaacatccacactttttccgtaattttccaaatatcctttgtttttcaagatgtcaattatcgtagcggaatctttcaaatatccattccgtttttcaaaatggagcagataccaatattcaaatgccggattggaatatgcgattttgtacccatgcttctccgaataggaaattgcagcttgaagctcagagtctttattatcatcacagtcaaatacacaccaaagctgatctccgtctttcggataataatctgcttgagagatcagagattttgcgtgcttcaccaaatgttccgccgctttatgttttgatggaattgggataatatccaccaggcagtttcgtgaacgaaaatgtttgaaataaagtgtctctgtttcttttccttcgcagatgatataaacaatcggtttacgcttccgccgcttaactttgttcggatcatactcttttcgcatcttgctcatcaggcgtcacctccgataaaagggattgcaccaaatcgtccctgaagataacccttacgcacattttctccttttcttggagagaaagatgccaacgagtaaagctctgttgcacaagtctcatcgtttttttcagcaaaccaaatctgatctctacggaagaaattcaagtcaagcagcattgcatcgtgtgttgtaaaaatcagctgcgctccctttgtattgacagccttatcctgcaccatttcaatcagccttctggttaaaagaggatgcagactatcttcaatttcatcaacaactaaaagtgcgccgttttcaagtgcctgcaaccatcctccgatgcgggcaaaaaagtgttgtgtaccgacagattcctgctccattaaaagctgaaagtattctgttgtaccgtcctcgttaataattcgatgtgttgtcgtaataaccggtattttaccagaggtattcttgattgtaacatcggtgattccaagatcggcaagcatcaattcttttaagattcgagccttcttatcatcaccgctgacaatctgggcaacagtttctgaggtagctggctcttcatccatcaggaatgtcaacttttccaggaaccactgataagcattttccgtctgaggcagattccagtcattagaggacaccagatagagcttattgtccggtgttcggttactcaaagtaacctgctcatttacattttcccggaactcatacactccattttctcttgaaaaaattaaggcttcacggccattcggccaatggtaaagatactctttgtaaatcttctttgcatcaaaagaaaaaccgtatgtgtaacgaactccctgaaaaataaataccatttcaaaagaagtcggaacctttgttcctccaaacggctcccacggcaacttttgtcccttagaaacttttgcagcatttcccacaaccatttctttcatcgtcatcattgcatgtaatacgttactttttccggctgcatttgcaccgtaaattgcaagtacgggcagcaatgccttcttttcatctggacgaagcagatactcttcaaatgacttatccttagaggccgcaaaactgatcacggcactgttttttattgacctgtgattttccactgtaaactgaatcagcataattgaatacctccattctcagtattcgtattttcagtcactattataacagttaaaaatgccttggtcaatatttatagattatttttgcagtttttctgcgaaatttataaataaattctttctcagccatttttcacaaaatacttatcatactaggctgaattggaatccgagcttccagtttgcaagtttaagttctgatttagctaatcgcttgcataagtaaattctggcaaatcaaaatatcatgatttttatggaagttagttttgcaaagttcttcaaaactggaatttactattagaaacaagttgttttatgcttcatatgctgatattctttttttgtgatcttaatcctctgaaaaaagagtcacgttaagcggaggtcgaattttatttcttttttcgcaagattaaattccacccctcattcggttcagtatttcttccgaatggcgctacgtttcttattttttcagtaatagaggtgtaaggttaatctcgttagcgggaacggattttattcctaaccatacaaccagtcaaatatttctgtaactgacttggcggtattgttatcacggataaaagcaagcattgtcctatatttaaccactaaaaattgagtgaaaacggctctcgtttggtcaaatgatgtcaaactatatcagcccgtttaggtataagaaaaccccagaaaaccttgattttccggggtttttgaaccattttgatatagtctgagcagtcgattatctctttgaaaactgtggtgcacgacgagctgctttgagaccgtatttcttacgctctttcatacgtggatctcttgttaagaatccagcagccttaagagtaggtctgtactcgttatctacctgaaggagtgcacgggagataccgtgacggatggcaccggcctgtcctgagtatccgccaccctttacgtttactaaaacatcaaacttgtcaactgtctcagttgctactaatggctgacgaacgattacctttaaagtctcaagacctaagtactcgtcaatatctcttttattgattgtgatctttcctgttccaggtactaaataaactctggcaacagatgattttcttcttcctgttccgtaatactttgtattagccaatgttgtttacctcctctgattagaatgttaaagcttctggcttctgagctgcatgcttgtgatctggtcctgcgtatacaaataactttgtgtacatctgacgtcctaaaggtccctttggaagcattcccttaacagcgaactcgatgacacgctccggatgcttgttgagcatttccttaagagttgtctccttgattcctccaacgtatcctgaatgacggtagtataccttctgatctaacttcttaccagttactttgatcttctcagcgttcacaacgattacataatcaccggtatcaatgtgtggtgtgaagattggtttattctttcctcttaatactttagcaacttctgatgctaaacgtcctaatgtcttgccttcagcgtctactacataccactttctgtcgatggtagcaggacttgccataaatgttttcatgggttttcctccttgatagatattcaaatcaataaaatgcgaacagtttcaagcctcgtatgtccggacgctgctctttcctgctctgcttttctatatagtttaaatgctcgccggggcttttggctcacatttacatactatcacagacttatatattatattacccgggtcttttgttgtcaagcagatttgtccctcaaataccgctttttcctgctttatccacaggttctgtaaaaagtgccattcctgtccacaatggaaatctgtttttcgacattttatacaaatccgcgcagcttttattcgtactccaatccgatcattgtcagtccgtgtgcaggagccgtcggtcctgccacactccggtcacaggcatctaaaatcgtctgcatctcctgtggggcaaactctcccgctcccacctttatcagtgttcctgcaatgatccgcaccatattatacaagaacccatttcccgtcacccggatcgtgataatatccgcttctttcgtgaccgtacatgcatagatcgtccgtacgctggttttcgactgtgcattgaccgcacagaaacttttaaaatcatgctcgccaaccagataatccgcggcctcctgcattttctccacatccagcggataatgataaaaatatgtatccagccgcctggtcggcatgcggaaccgccggtttagtatccggtactcataggtctttcggcttctggaaaaacgtggatgaaaggtatccggcacttcgcaggaatcctgcaccacgatatcttccggcagcctctggtttaatgcgtagctgatcttctccgccggcatacgggtatccgtatcaaaaatacagacgtttcccagagaatgtacccccgcgtccgtgcggcttgcgccggccacgcggatgtcttccccaagaagcgcctgcaatgcttcatttaatttctgttcaatggtcacaccgttgggctggatctgccagccgctatagttggttccgtcatatgcgacgaccatttttactctcatatttcttaatcctgttctgtcaaatttcctgttttcagatgatttatatgctgctgccggcggtcaccgtcctgctactgtggccagcgcaacagcactcgtgcaacaatcacaagcacaagaaatgcaatcaatatcacataggctttgcggtctgttccctgatagcgcagcggtttcatctttgttcgtccctctccgccactgtagcagcgggcttccatggccatggcaagatcgtccgcgcgacggaacgccgatacaaataacggaatcagaagcggcaccatgcttttggctttctggatcagattgccgtcctcaaaatcggcaccacgcgccatctgtgccttcatgatcttgtccgtttcctcgatgagaatcggaataaaccgcagggcaatggacatcatcatcgcaatcgcatgcaccggtatgtgaatccggttcagcggagacaatgctttttcaagtccatcggtcagctggtttggcgtcgtggtcagtgtcatgagagatgttccgataatcagatagatcagccggatcgtcatgagcaccgcattcataatacctgtactggtcagatgaaacggtccccagtgccagtactccgtaccggtcggtgtaaagaccagattaaacactgccgtaatcaaaagcagcaccacaatggcttttaacccttttacgatatacgaaaacggtacttttgaaattttgatcataaaaataagcataccggttatgatcgcaaatcccaaaatgccctggaacgtaaacagcgcaataatatatatcattgtcgcaaataattttacacgcgggtccagtttgtgtacgacagaatctgccggataatactggcccagagtaatatctcttaacataaatttctcctgtgctctgcaaacactaaatgacgtttttctcccgaagtgccgacagaattgtctgtgctgcttcttttgccgtggttgcctgtgtatccacaggaagtccccgttccgcaagttcatgtaccagatacgtcacctgcggcgcagcaagtcctaccgcctcaagctccttataatgcgcaaacacctgcttcggcaaagcatcaaacatcacggcaccgtgattcatcacaatgatgcgatccacatattccgccacatcttccatactgtgcgataccagaagaatcgtgattccaagttccctgtgcatcttagaaaccagtccaaggatttcatcacgccctgccggatcaagtcctgctgtcggctcgtccagaatcagcacatccggtttcattgcaagtactccggcgattgccacacggcgcttctgtccgccggacagatcaaacggcggctgataaaataactcttccggaaacccgacgttgcgcagcgcttcaaacgcccgcagttctatatccctgcgatccagtccctgattcttcggtccaaaacagacatcctcaaaacaggtggtctcaaacagctgatgatccggatactggaaaaccagccccactttgctccgcagggctttcatatcatacccttcatcatagatgtcctgcccatccacatagatgcttcccgatgatgcccgcagcagtccgttcagcaactgagtcagagtcgattttcccgatcccgtatgaccgataattccgataaattcgccctgatgaatctgcagattgacatcctttaatgcctgaatctcataagcagtaccgtcgctgtatgtgtaattgatcttgtctaaaatgatttctgccatctttttatctcctgcctgtgcgcatatctttgtctaggcatttgccacggacataatcgcatccaccagctctttcctcgtaaggattccctgtggaatcggtacgcccgcgctgcgcagttcatctgccacaagcgttgcctgcggtacatccagacgatgttctttcagctcgtccacacgcgaaaaaatatcgcgcggtgtaccgtccatcacgatctttcctttctccatgacgtacacataatctgcgtcaaccacttcttccatataatgtgtaataagaatgatagtaacaccctttttcttattcagatcatgtgcggtagcaataacctctttgcgtccgttcggatcaagcatcgctgtcggctcatcaaagacaatgcatttcggttccattgccacaacaccggcaattgcaacacgctgtttctgtccaccggaaagtttatttggagaatgtttgcggtattttcccatatccacagcttctaaactctgattgacacgcgtccagatttcctctgtcggcaccccgatattttcgggaccaaatcccacatcttcttctaccacactggcaatgatctgattgtccggattctgaaataccatcccggcagttttccggatcggaatggtattgtcctcatcgagtacatccattccatccacccagatcacgccttctgtcggtgtcagcaacgcattgatatgtttggcaagtgtcgacttgcccgatccgttgtgtccgagaatggcaatgaactgtcccgcttttacatccagatttacatgatcgagtgccgtcgtaatagactcaacattgccttcctcatctctgcggaaaaattcgtgtacaacattttttgctttgataattcccattttaatcgtcccagctcagtctgtgaagctgtccttccagcttcatatggtcaaaatcgttctggcgcagtgcctcataaagcacaatggcaacagaattcgataagttcaaagaacgggtttccccgatcatcggaatacgcacacaggtatccggattcgcctttaagatttcttccggaattcctgcactctcttttccgaacataatgaaacagtccggttcataatggacatccgaatacacatgacgtccttttgttgtcgcataataaatttttgcacccggatttcttttacagaaatcctcccagttttcatatacggtgacatcaagatctttccaatagtccatgccggcacgctttaaatgtttctccgataaagaaaaaccaagcggctcaatcagatgcagctttgtaccggttgcgacacaggtcctgccgatatttcccgtatttgctggaatttccggctcatgtaatacaatatttaactctgccatttttaattcttaatctcccgaatctccgttacaaactcagccacgcgatccagtgcaatccgcagatcatccagggaatatgcataggatatacgaaggaatccctctccgcaggcaccgaacgccgtacccggaacaaccgcaactttcttcgtctgcagaagttttgttgcaaactcatcactggtcatacccagatccttaatacaagggaacgcataaaatgctccaaatggttcaaaacaggaaagtcccatctctttgaaccgctccagtacataacggcgtctgccgttgtactcttcccgcatcatggcaacatcttcatccccgttgcgcagtgcctctaccgccgcatactggctggtggtcggcgcacacatgatcgcaaactgatggatctttaacatctgtttgatgattacttccggtccacatgcataaccgagtctccatccggtcattgcatgcgatttggaaaatccgttgatcacgattgttcgctccctcattcccggaatggaggcaatggatacatgattgtccagataggtcagttccgcatagatctcgtcactcaggacaaacagatcatgtttctttaccacttctgcaactgcttccagatccttcttttccataaccgccccggtcgggttatttgggaaaggcataacaagaagctttgtcttcggcgtgattgcagcctcaagttcttctgccgtcaggcggaattcgttttctgccttcagttcgatcggaaccggtgttccatttgccagtacacaacaaggcacataggatacataacttggctgcggaataagtacctcatcttgcggatctaacatggcacgcatggcaatatcaattgcctcactgcctccgactgtcacaagcatctccttgttatagtcataggaaagcccgaatctccggtcaagatatttggaaatctcaatttttaattcctttaaacctgcatttgaagtataaaaagttcttcctttttcaagggaataaattccctcatcacgaatatgccacggtgtatcaaaatccggctctccgacgccgagagagattgcatcatccatctcactgacaatgtcaaaaaatttccggatacccgatggctcaatggttgtaattgtttttgataatggatttctcattatgccatcataatcctttcatcttttgctttcggagccataacagttccgtggtctttatatttctttaaaataaagtttgtctttgtgctgagtacctgatccaaagcagaaagcttatcggatacaaactgggaaatctcacgaagtgtcttcccctccaatgtaaccatcaggtcaaatccgccggagataagatacacggaatttacttccggataattgtaaatgcgctctgcaaccttatcaaatcccatgccgcgctgcggtgtcacacgcacttcaatcagtgcagttactttttccacaccggctttgtcccagttaatcagcgtatgatatccgcaaataattccctcctgctccatagcttccagctcattcatgactgctgtctcatctacaccgagaattacggccagctcctgtgtatcgatgcggctgtttttttctataaaagttaaaatcttctctctcatattttattgttctcctaattacattttaccatattccataattcgtctgtctgtgttgtttctaagaatctgcgttcctccccattgataagtacacggtcattgctgtcgattgtccttccgataataacagcttccccgccagcctgacggatcgcatgcaccagtgcattgccatctgccgctgccagaagaagactgcctcccgacagaagtttgtaaggatttaaatcaaaaaattcacagatttctatggtttcctgacgaattggtattttcttcagatcaatttccagtccgacgccggaacactgccccaattcccagagagctccgaaaacgcctccctctgagaggtcgtgcattgcagcaacgccagactttgcggcgactgcggcctccgaacggatagaaagataatctatatattttgccgctttgtcaagaaacggctgtgcgtatctggccgataactcttcccggtgttccgttgcaagaatcgctgttccttccagcccgacccatttggtcacaatcacatccatatccggctgcgcccctgctgctgtgacaaataattccctgtcagcttctcccactgcctgaacaatcagttgcggagaggtcactgtccgaaggacttccgtgtgtcctccgagaaccggaatctgctctttctcacttacacgggatactgccgaaatccatgcacgcagatcattttcgcttgcggatgtcgggagcagaagcgtcatcgtaattcccaatggttttgccccactgcatgcaagattattcaatgccgcataaacgccggcttccggaaacgtgtcaaatgcacggcaggcttccgcagtaacgatctgctttcccgcagaagcatccactgcaccgaaatcgattcccactcccggtgcccggaccgcagaattatgaagttgtcggagaaccgagcgctttaatatcgactcggataattttcctgctttcatactgttattttctattcgctttctttggacgattgtgtttttttcgtggatgtatttgttgaagatgttgtttctttcttggtatcctgttttttggaatcttccttctttgtatcttcctttttattattttcatcctttttggaggaatcctctttctggttcgtatcgctcttgtctgcgtcctcctttttatcggtatcgtccttcttttcttcttctttctgctcttcttctttcttttgcgcgtttgtctttaaaccggctgccgcacttcttacttttgcttcatccccgattgtaattgctgcctttaaagcagaaagcgtctcgcttgtcgcatctttggttccaatggtaataagctttggagttgcctgataattactcttgttgaacagatccctgctctgctgttttccgtctaccttcacaatcttccacaactgcgcaatgcatccggactgtccggactgggtaacagaaaccgaaccggcggtaagggaagcatccattgtaaactgcacctttggatctgtctttgaaacggtttcactttcaaacgaaatctcccggttggatggtctcgtttcttttccatatacattaaaataaatgataccgccactgcaatatccttcgatatataccggcgcatccagattatttttaaacttcagatctttataatttccggcaattgccgcatccatggacggttccacataatgaaccagcatggaatgattaaaacgcatcgtaatttccagttctgcccggataactgcattatataaagtcgttgcaacctgacagattccaccgccaaacgattccactaccgttccgttctgataggcaccggccagttcatatccgttctcctgtgtaaacgggctgaccgtttttgccagatcaaactcctctcccggataaaggattgtaccatctactttgctcactccggttatgacattttttgcacgtcctgcactcgaacttgcaaagtttgtcgtataagaaccgatcagatccgtaatttctgcgagttctttctcatccccgcgcggttctaccgtctttgttaccagatcaatctcattattggagccgtcccagccctgtgcaagaaaatcattgattgcatacacggaatttacgacatccacctcgacgccttcttttccctttacaaattcaaattttccattgacacgctttaatccattatcaacagccccgacggcaagatcatctgcgctctcatatatcttttcggccgtcgcctgtttgtttacactcagatgcatatcgagaaccagttttttctttttgagatcctgcagggttttataccggttgatcagacttccggcgtgtcccaccgccaaagcttcctgcacggcagtatccgcatccgcggtcactcccatatcttccgcagtcatctgaatggaaccggtttctcctctcagcgtaaaagttgtatccatcagcccatccacgtattcttctaccgcagatatcgcctgattttctgtcattcctccgacgtttacatttccgatggaaattccattttcaatggtaatctcctctgctgccatcactgcctgtgtatgagaaccgagtcccaccacacaaaaaagtactgctgcagccattcctaactttgttatcttcttcatattcttcctttaaaataattttagcgttatcttgtattttaacataaacaatcactttttcaagtgccgctacccataaatcagcgctgaaaccagtgttgtaacaaccattgcagcgataacaaccaacgatatgagtgcaatcagctgtctttttcgttttgaaccattaaaattatacatactattcacctctttcgcaaaatcagttataatgaatacacaacaatatcagaaaggatttccattatgtttgtatttcttgctatttttatcgtttttctgctgtatattaactttttgatgcataaaaataaacgcgcccaggaaaatctcgaaaaacagttctgggaccgggagcgcagtgcgaatttcacacgcaaaaaagatatcagcaatcttaattatcttatcataacagaagataaaataccacaaaaccttacgaccgatgccaaaaaatcactggaaacactatgcggtcagaaaatgctgaatctttcttccatgagtaacaccgacctgaaacttgaatatggtgttgcaaacctggatgaactcagcgcatgtgatgaccgtttttccacatttgaacgaaatgctgccatctatgcccaggaactgagtgatgccggatataccgatcaggcacgccagctgctggaatttgcagtttcctgtcatgtcgacaacagcagcatctatacacagctggcagccatctatcagaccggggacaatctctccggaatcttgcagctgcaggaagcagctgcgcagcttgcgccgtttccgcaaaaaatcattctggaaaaacttaaaagtttccagccctgatcttatcctgcagccgggaggcttcactgcgtgtaagagtctcccagctgatactgtctttccttccatattgttccatcagttccctgagccgttctttctgatgctccgttgccggcgtctgtctctttgccttatacaccagaggtttcgggacaaacagttccgtggaagcaccttctatggattttaaattttcaaataccttataggtttctactgcatcatccagtgcccggtgtgcatgttcccgttcaatctgaaaatattcgcacaggctttccagttttttcgactgtgcccccggaaggagtgcccgcgcaatccgcagggtatcacaggccgacaattccagtggaattttctgattgacggcccactgcttcagaaaactgtaatcaaaaatcagattatgtcccacaagaatatcatccccgataaattgcagaagttcctgcattgccacattctcttctttccccaaagccgccatttcatctgtaatcccggtcagctgtactaccgtttccggaattgacactcccggacgcacgagcgttccatatgtatctgcaatctctccgttccgtacacgaaccgccccgatttctattactttgtcccttttcggagccagtcccgtcatctccagatcaagaaccgtataatccattttatgcacctgccttacgctttcatacatgtttattatacacatataagaaaagaaaaccagccagaatatggccggttttcttccacaataacgctctttataaaattcttccaatcaatacatccagtcctgccacccacagcaacagtgcgccaacgatatatactttggtttttgcttcatatccgacacggtatccggtatagatgccgccgatcacaaatgcaacggtacatacaacaatcatgatcagaatcataagcacattcgtttccagaaatccaaatgcaattcccgtaagcagcgtgtaaattccactgatacatgccatgcggacaaatctccggattccaagatgatgttccagatgttcttccacatgttcgttgcggattgcttttaccatcagccggatgccaagaatcataaaaatcaccatggatataatctgtcccagcagcttttcgtccggcaccgaccggtaacggcagaacagggaggacaaaaaatgccccagatataacgtaatcagctgtgccagcgcaacgattccacagatcactgtcagattttttttatttatttttgcaaccagtgatccctgacattccattgctgcgaaaatatccagagatacccctgctattatcagcaggttttccatccagttcatcctttttcctccgaccatcaaaattatttgttattttcactgtctgccttgatcgcatcctgtttataaataaattttacgcttccgtttacaccgtctgcaacctttgtaaatgtctggtaatcctcacccgcatcaagcattacctgcagtttgtcggtcagcggtttgatatctccgttatagctgttcgcaatcttggaaatacccttctcgtcgaattctaccatgccatctgccagcgtatgggacccgtcatccagtttatctacaccggacacaatctttaccgtggcatcgttaagtgccttgattcccttcgtcagtgttggaactgcgtctgccagagactgtgttcccttactgagtgctgcggaaccggtaaccagactgtaaccgttttcctgtactgcttcaatctgctgtgcaattgtagcctttgcactctctgctcctgtaacagcggctgcacttgctgcctgtacggccacattctgacatgctcctgccagctgtgtagccagtgtctttaagctgctctccacaccgtctgtcacctgctcattgtttcttcctgctgcaagctgtgccttgattgtgctctgtgtcttgtgaaagagtgtgtcctttgccccactctttgcatacagcagttccgcaagctgtgcacttgtcataccatccgatacggcatacataaccgttgacgtctgatcgtttgcctgtgcgccctttgcccacgctgctttaatgccggcagccgcctgatctgcagtaagtttgctgtctgccgcctgtcctgcagctttcagcaatacctgtcttaccacttcattatacacggtttctgctgcatttgcactataagcgccatcataaagagaagtaaataatgcgccatccgttgtgctgccatcttttcctgtgctgtaacggagtgcggcatagatctggtttgcgacttcctgcgtttttccgtttgcaaactcttttgccaccgtctcggaagcggtctttgacgctgcctgtttctctgtatcactcatctttgtatttaacgctttatcaagtgtctggattcccttgctgatggattctgcgctggtgtttaatgtctccacacctttgcccagatctccgctctttgaattcagctcattcatgccgcttgcataatccgcaagatttttctgtaacgtgtccagtccatcggataattcttttgatccgtcttttaacttgctgcttgcatccagcatgtcatcaatcatatcatccagagaagaagaatccccgctcttcatggaaatcatgcttccggcatttgccacgatcgtcattgccgtatccagcttgaaatcttttacatcggcagtcacttcgaaatcttccggaagttccagatcatcgatgaaatcagaatctttcacattcagactttctttgattcccggcaatgcatagccgataaccacattgctgttcccgttctgggaaacttttccgttctttacttccacattgctgaaactgtcatccaataccagtgccgttacggctgcaaacggaacctttaccgtctgcttgtttccgtttacggtttcttcataagaagaattatttgtgtaatcataatgtatggtaacttttccggattttccagccagatccttcggtgcaatctcatttccatccagataataagtaactttcagagaaaccggagcttcactgtctgtttttccctgatagtaaatatcggctccatctgcctgccaggtcagcttctctccgttctgtgagaactcctcgcttcccttcacatttttgatatctgtcagattggactgatcctccagtgtagcggactggtttttattgatcaggtgatcggtgacaatggtatcatacacacttcccgttgcatcggaaataaggtaaacattttcatcttttccgatttctttatcactgacagatacctgaagcagatcctcaatatcatccttcttatcggaagaatcctctttctgctctgtctgaactgcagcatctttcttctgatctgcctgcacggcaactgctgtcatgctgcttccaagaagtgcaatggtcagcacacctgccacaatacggactacatatttatttttcagtctggtttttaactctgataatttcataattccatcctcctatttgattttgttgcgaaatcctgcacttgatgcacagatcacacggtcaaataccatgaacatgcttggcagaataaagattacgacaatcatactgatgatcgcaccacgtgccatcagcatacataatgaaccgatcatatcgatgttggaatataatcctacaccaaacgttgctgcaaagaaactgagcgcactgacaatgatcgactgaatggacttgctcaatgcatcggtaattgcttctttcttatccataccgcggaaacggttcttcttatacttgttcgtcataagaattgcataatcgaccgtagctcccagctgtatggttccgattacaatggatgcaataaacggcaacaccgttcctgtatatgccggaatacccatattgatgaaaattgcaaattcaataacacataccagaataattggaagtgaaatggacttaaatgtcagtaaaataataataaaaatggctgcaatagaaataatacttacatttttgaaatccacatcggtaatctcaatcagatccttggtacatggcgcctcaccgatcagcattgcggtattatcgtattttttaataatcgcattgatctcatcacactgtttatttacttcatccgttgcagatgcatattccgaaacaatgaccatcatctggtaatctccactcttgaagatatccttcacatcgtccggaatgacatcctgcggaaccatcggtccggtcagggaatccatcgaaaccgcaagttttacaccgtctacttttttgatctcatcgatcatattcatactgtctttttcagacagactgctttttgccagaaccatgtgggttgcacccatatgatactgttcggacagcttatcatttccgactttactgctgaaagtctccggcagcgtaccagtcagatcataatatacattggtatgtgtatatccgtagattgccggaatcagcacaaccagaaacgcaatgacaaataccacatgatgttttgtgataaaccctgcaattctactaagatccggaagaattactttatgtctggtcttttcgattgccttatcgcagacaagaatcagggacggaagaatcgttacacatccgataacgccaaagacaaccccctttgccataacgataccaaggtcttttccaagggtaaagctcataaaacacagtgcgataaatccggcaactgttgtaatggagctgctgaccacggaagtaattgtattggaaatcgcatgtgccatggcacggtttttatctccgtcaaaccgctccttctgctcctgataactgtgccacaggaaaatggaataatccattgtaacaccgagctgcagtaccgccgccagtgccttggtaatataagaaatctccccgaaaaatacgttggaacccagattgtaaataattgccatgccgatactgatcaaaaacaggaacggaacaactacggaatccatcgtaagtgataatacgatcagagaaagcacaacggcaatcagaacatagatcacactctcattctctgccagttttcggatatcattgttcaccgatgccataccactgacaaaacactgctttccaaccagatcattgatcgtctggatcgcatccatggtgccgtccgacgacatggattcatcaaacaggactgccatcagctggctgtctgcgtctttgttattgaaaaagttgtagatatcatccggaagtgcttctcttggaatactaaaatccataacggaaccataccagataacattttttacatgaggtacatcctcaatcttatctgctattttctgcagatccttatcctgcattccctcaacaactacaaaagagaacgcgcctgttccaaattcatccagaaggatatcctgccctttcatcgtttcaatctgtcccggcagataggacaaaatgtcataattaattctggttttcatatagccgatcgcggatggaatcagcagtaaaaaagccaggatcaaaatcagaaaccgacatttaacgactccttttccaaatttaatcatttttttcaccatcctctatttttctctcagcctatcataaaaaaaaagaccgaatatgaaaatattcaatcttttcgtcatgtactgcatgattatacattttgagtgatttgtatgaattcgtatacaaatcattcaaaatgtcatcgcatattctttttataattctttgatgatgtcgatcagagaccgggtcagcatatactgatatgcttcggccatttcgcgcggcgagatggtcattcccatgctgatccattcctctgttgcaaaacacatggactgtgcataataggaagatatcacctccggcgtcagccatttgtgttttgaaacccttccgctgctttcgttttgaatcagttcaagcaatacttcccgcacacatttttttgcgatatcgtgaaatttgaccgatccctccatttttaccagctgtgaataaaatgccttgtccttttcaatgttggtaaacagcagaaccattgcttctataatcatatcattccggatcagaggttctaccggctctaacagttctgtccggatgatccattcaataagctcaaatttatcctgaaaatgattgtaaaacgttggccggatgacccctgctttatcagttatctctttaattgtaattttttctaccggccgcctgacagcaatctctttcaaactttttgcaagcagctggtcaatatcggttttgccctgtattgccatttcgtctgttatccttattcgtcaaattccatggtcacaaagtaccctttttctgtctccttcacatcaatcacatcgccttcccggctttttaaacgttcgcctaccgcataatttcccgacattgctattgcatgctcaatggtataataataggaagtgggaagttttccctctgtcaccttcagatgatcccctgctttggtcagtcccggacgttccattttaaattccatctgtctcatcacggtcaccttcattttccacaaactctgtatcaacagtctctgtgcgccgtctgtaatccctcgctgcacgcgttgctgtgacagcaatccacagattcagcgctccgttgataatcagcacgattcctaccagcataataaactgtttcaatactccaagcggacagaaaacacagaccagaccacagaccagacagatgatagcaaatacaagatccatgccccacttttcatatccgtattttttggcattcacagcctccgtcaccgcacgaattccatgaaatacaagtcctacacccaatataaccggaaccagactgacaatcagcgacggctggatgagaaaccagattccaactgcaagtaccagaattccgacaatcgttgatgctccaaatgttgcaaggctcaaaataaagcttcccagataaataattccaacgatgatcattgcaaccgaaagaattgttccgatcacatcaatgactccgcctttccacacaacaaaaataattccaagcacaatacacaaaacagaagaaagcagataatccgcctttgcccgcttcaaaaattctctcatgaaatgatgcccccttttgaaatatcttttgcaacattataacatttccttttttattgttcaacttttcctctaaaaatgatatactgtgcgcggaggtgaatatcatgggaaaagaagtaaaaaccaatgccgtgcgtattctggaacgaaataaggttccctatgaactgctgacttatgaatgtgacgaatttatagatggaattcattctgccgaagccactggcaccccggttgcccagacttacaagacacttgtcatgcagggcaaaagcaaaaaatactacgtatttgtcattccgattgccgaagaggttgatctgaaagctgccgcgcgtgcagtttccgagaaatccgtagaaatgatccatgtcaaagatttaactgcaatcactggttatgtccgtggaggctgcagtcctcttggcatgaaaaaagcatttccaaccgttatcgatgcctctgccaggcaatattctgaaatttatgtaagcggcggccgtatcggaaccagcatccggcttgaccctcaggatctggcacgggttgtccgcgctacttttgcggatatccttgccagaccataaaaagaaaagtgtgccagatttatttccctgacacactttttcttttaattttcgcccggctgccggataatatccagcacacgctgcaactcggctccctctgccggagcctctccatagtcaacatgcttccagtcttttttgaattctccaagcagatgttttcccggatcctgggtccgttcaatcgtaaaatatctgccctcctgcgtttcgtcattccatgcaaaatatacacggaaacaggatggaactcccatatcgcgtaccggcagatccacacggacaatcagtaaactgtcggacaaatccataaccataacggagaaatcttccggcagatacggatacatacgtttctgctgataacattcctcaaaaaactgatccatatattcttctttcttctcacagaggtcatccatcatctgtttgccctgcgcaaaaaagcgctttggcataaaaccaaattcaaactgcttacgttcaaacaacagatactgttcctgtgtaagctgcatcttctttggctgcgctccctctttacgcttcttttccacttcctcgattttttccaccagtgcacgtttaaaaatcagattctgtgtgaatggattgatcactattccggataccttttcatcctgctgaaaaaccatgttattcgttgcaaggaacggcatgtttataactgcttcactcctcggagattccggaatctcctttttacttgtataaattggaagaaacattccgtttttcggactgttgatcagacacggaaccggcttcttttcatcatttaaatttgccggaacaagcacacgtctggttcgcatcagctcgatcagggcatttaaattctcaccggttttttctttcagatatagatctatctgtgcttccacatcttcattttttacatcaagtgtcatgcttggatctgttggtttctcctgcttgagatcctgcttcttcatgacatcttttaacttctttttgtcgatcatctgtgtatatctcctaaccccatgctgtcggtattgtacaggttaatccctgtgctcatgatataaaagcattttagcacatattttcaggagattccatacctttatacggtttttgaatcatcaagcgttttctggatcagtttatcaagtcttcttccgatcctggcatatttttcaatgcggcgttccatttccggcggaactccttttttgtaagaaacccggttatccattcctgcccacgcatccatgatcatcgtccgcagctgcaattccacacgaaccacagttgtctttcctttgtaagacatcgggatatccagaacgatatggtaactctcatacccatttttctttggttttcgaatgtaatcttttgcctttactacggtatatgtgtctgtttttccgatctgccgcgcaatccagtagatttccttgacactgtagcagatacagcggaccccggaaatatcgtttagtgcagtaactgcggtatcaaaatccacgtcataatccttgcgctgcagcttctctgcaatgctctccggcgtcttcatccgtgtttcgataaaacgtacaaatccctgtcctgttttttcttcatattcccggttcagttcccgcagccggtttaccacaatctctcttgccagtgcatgttttctctgaaaatcatcatcttgccagtgcttccggagtttttctaattcatccataacttaccttccctgctttctgttatatctatcctattctccacttttctacagaataacaggggtgtgtaaatacagacttcttccctatgtaaattgtttgtaaaaactatgtggtgagaatctttttttccacaagcattttaacaaattcccgatcccggaaactccatggctgcgtctcacaaaatggttcgttcccatcgataatctcctgtgcggttgcccactccagatgaaatcctttctcgatctcgctttcggtcatgtgcgtctgtgtcatttcttcttttgcatcacagaaaaaaaagcaggagtggcagacatagatcttgtttttttcaaacagatcgcgccgccgctccacaatttctccaatcggacggatggattccggaatcacaataagcccggactcctcccccacttcacgaatcagtgcatcttccagcttctcgcccggttccacacctccgccgagaattttataatctccggcactgccatgttgtgttgcaatttttccatcacgaataatcacgccgcgtgtcgagtatttttcgaacacgggcattccctcttcataatcttttttatctaatgttaaaagtatctgcacggcatttctcctttgctgttccgacatacaattttgtatcattatagcactatcatgggggtttgtgcagatgttttaaatataagttttctctatgcgacgaatttgtgcgagtgttttaaatataagttttctcaatgtgacggaagaagggggacattctctttctacagaaaaatttgcaaattagcgccgatattgatttcaggttggtttagcaaaagttttacttttatgctattagctttatatgatggaactacggcgcagttgcaaatttgttcttccgaaagaaatgtcccccttcttcctgtggattggagaaaatatagttgagaaatatatttccgcaaatcctgtctgtggaacaaatatacagccaccttcagtaaaaaatgtcatcgtggtatctatgccaataaaattcatgtaaaagataccattgtggtacctacacgctgaaaatttaacattcagataccggaaggtctctatagatcaaaaattgcttttccagataccgctttttctaaaaaaccggtatctggaaaagcaatttttactatataggtgacatttcctgatttcaagcattaaaatttcggaaaactgtcacctaaaactttaatttttcgtctatagataccccgccttatcatcgagtgatttaacagggtatttttatgtttattccagttcatgggattcgtagctgtttttgaggcgtccctttaactgcggggctgggagcctttatgtttgttccacagacaggatttgcggacatcattcttttacttatggttttccaatccacaggaagaagggggacatttctttcggaagaacaaatttacaactgcgccgtagttccatcatgtaacgttaatagcataaaagtaaaacctttgccaaaccaacctgaaatcaacatcggcgctgacttgtaaatttttctgtagaaagagaatgtcccccttcttccgtcgcatagagaaaccttatatctaaaacaactcccccgcaaatccgtcccatttgccaaacccaaaggctcccagccccgcagttaaccagcaatttataaagttttgagatactccacaatacttgtcacactgttggcaccatccgccaccgcggtcacaatctgacgcagcttcttggtgcggacatctcctgccacaaaaagccccggctgctccgtcaccccgtcttctccggcacgcacatagccatgatctaaatccagcacagaagccaccgcatcggtctgcggattcataccgactgcgataaagataccgctgaccggcagttctttttcttctcctgttccggtgtttgcaattaccagatgatcgaccatctgctccccacagatttctttcaccacggtatccggcaggaaggtgatcttcggctcatttgccacctgttcctgcagtaccttcgtgccacgcagttcctgtctgcggtgaatcagatacactttttcacatccggctgccagatacagggcatcttccagtgccacatctccaccgccgacaaccgccactgtcttgttacggaaaaaagctccatcacaggttgcacagtaagacaccccggctcctgccagtgtttcttctcccggcaccccgagtttccggtgtccggctccggttgccagcagtaccgtttttgtctcatagacggttccggaagcaccggtgattttccacgttccgtctgtatttttctctacgttatccacttcatcgctgatgaacggaacctccagtgcttttgcatgctgctcaaatttctgtgccagatcaaacccattggtttccggcagtcccagataattatcaacttcctgcgtataaatcatctgtccgccacccatcggctctttctctaaaacaaccacatccagacaggcacgctttgcgtaaacagctgccgaaagacctgccggaccgcttcctataatgactaaatcgtacatgttattcctcctgattttcaaaaaaatctatttcataaataatggcatttttattctttcctattttaccatacccctatacaatgcgctattttcttttctccaataataacaaaatatgctccttttacaaaaattttacgtgattcagggttgaaaaatccatttacaaatgctaccataaccaaggatttaaatccacaatcataaaaatctgagtaatggaggtgaaattcatggacagtagcgatagttttgggcgaagtagacatttgaatgccgatgcttttttcactggcaaaattatcgttttcactggaaaatgaattttgccgattcatgatgtttaaagcaccggtaggtgctttttttgtgcctgaatatataaaactgtatacctgagcccttttctattgtgcatatccgcagcatgatgtagcttttgttgcacatgatgactgcacacaaggaaaggagaattcatatgaacaagaaatatttagagcttacaaagctgatccgaagcaaacagaatgaccatgaaatcttaaaatgcttatctaattatcacgaaaacgacattgccgatatgcttacggttatgactccaaaagaaaggaaacgtatttatacgcttctggggccacagaaaattgcggaaatcttcgcatatctggatgaaccacaaatctacttttccgaactctccgtcaaagatgccgccaaagtagtttccctgatggattccgatgatgccgttgacgtcctcgaaacactcgacgataaaaagaaatatgaaatcgtggaaaacctggacaaagctgccataaaagatgtaaaaatgctgctttcctatgacgatgacgaaatcggaagctgcatgacaaccaactacatctgcattccaaagggactttccgtccgtcaggcaatgagcgaactggtccgtcaggccggaaccaatgacaatatttcaaccatttatgtactggatgaatccctgaaatttgccggtgctattgatctgaaagatcttattattgcaagaaaacatgatgtgcttgacgatattatcgtccgctcctatccatcggtaaccgatcacgaaaaaattgatgactgcatggaaaaaatcatggattattcggaagattccattcctgtcctgtcgcaggacggtcatatgctcggtgttattacatccgaagatatcgtagagatggttgacaatgagatgggggaagattacgcaaaactggccggcctcaccgccgaagaagatctcaaagaaaccacggcacaaagcatgaaaaaacgtctcccatggctcatcatcctgctgttccttgggatgatcgtttcctctgttgtaggtgtctttgagcatgttgtggctgtacttccgatcgtaatctgtttccagtcccttgtgcttgacatggccgggaacgtcggtacccagtctctggcagttaccatccgtgtcctgatggatgaaacactcaccggaaaacaaaaacttttcttactggtaaaagaaatgaaaattggtcttttaaatggtggaatccttggtattatggcacttgcactgcttggcatctacatccacctgtttaagggatacacctggatcggagcatttggcatctctggctgcgtcggcatctcgcttctcgtggcaatggtgatctcaagcctcgtaggtactgtgattcccatgtttttccataagataaagatcgatcctgcagtagcatccggtccactcattacaacaatcaatgaccttgtggctgttgtgacttattacggtctggcatttttattactgatcatgtaaaaagataatctttgcaccatactaccgaaaaatgctgcctgacagcaatattgtacaggcagcatttctattcggcaatttctaagctgcataggagatatcgcttacgcgagataccccagatagaaaatctatccgcagacggataccctttactgaataaccagttcttcaatcgtcacatttttctctttgtcaatgtcaaaagctttaagcaccggctgatccatatccatcagggaaagaatcaggtaattgaccgtcggatcatatgccagacgcttatcttcctcggacggacgtgacggcgattccggatgggaatgccagttgccaagcggtaccagcttgtttgcacgcatatccttgacggctgctagctgttccttcgggttcatggaaaaatgctcattggtgtgatccacattctccagaaggtacaccttctcgatgatctttttgtcaccgtctttggtgcctgcaatcagaccacatgcctcttccggaaggttttccttcgcatgagctaagattttttcatagtctgcttttttcatggtaagcataaaattttcctccttacctctttcaatgatccgggcactcgatctgctcgtaatcaatcagttctgtgatggtcggatgatcgccacagattgcacacttatgatctgcctttggcagtttgatcgtgtggaattccatctttaacgcatcaaaagtcagaagctttccggttaagagatcgccaacaccgatcaggtacttgatggcttccatcgcctgtaaggatccgatgacaccgcccattgcgccgatgacacctgcctgcttacaggtcggaactgcatcctttggtggtggattcttgaatacacaacgatagcatggtccttctcccggaacataggtcatgagctgacccttgaaccggataattcctgcatgggagaatggcttctttgccattacacaggcatcgttgattaagaattttgccgggaagttatcggttccatcaatgatgaaatcataatctttaatgagatccataatattttcagaagtaacgaactcacggtatgtatttacagttacatccgggttcattgcgttcatggtctcttttgcagattttacttttgcttttcctacatctgcggtgccgtgaatgatctgacgctgtaagttggacagatccacttcatctgcatcgacaataccgatggttcccacaccggctgcggcaagatacattgctgccggtgcaccgagtccgcctgcaccgataatcaaaacttttccgttaaggagctttttctgtcccttcacaccaacctcctgcaggatgatgtgacggctgtaacgctccatctgttcattggtaaatgccattagaagcttcctcctcccatgaagtataagaattcaactacatcgttttcctttaatgttacgtttgcaagatcgtgattttctacgaaatcatcgtttacggtaacggtcacatattccggattttcaaccttctcgtcaacaacgagctgtgccagcgtggttccctctttgatgtcttttacgtttcctgcgattgttactttcatcggtaactcctcctaaatatattttttcacaatttcttccagttccggcttcttaatcagaccgcgcacacgctctgcttcctttccatctttgaaaaacaggatggtcggagaaaccataacggaatactgttctgccagttccccgtcaaaatttgcattgactttgaccacttttaagcgatcctcataatcatcttcgatatcgccaagaatcggtgacatctgtttgcacggaatgcaggaatcggaataaaactccaccagtaccggtatagaagcctgcaaaacctccgcttcaaaattatctttacttactcttgctgccatgcgcttaacctctcttgtctactcttcgagtttctttacaataaggtcataagttccatcttcattgtcgatcagctttaatacctgctgtccctcttccttgaaacttctcggtacgttctgcaccggctctccatcattcatatgtacggaaagcacctgtccgatctctaactcttccatggccacctttgccttgacaaacgtcatcgggcagaccacatccgtaatatctacagtttcatcaattgtaaaatcagccattgtatgcctcctttatcttctcttcaaatttatcaagtcccactctctcgagtgtcatgcggaaacgctctcctggattggcattgtcatcaaagaactggattgccgcatcggtaatgcggaataactgttcctcggatgtcacaagcggaagataattctcgcctttgtatacgcggtttccaaacagtccaccgaaagatacctcaaatgcaggtgtcgctttccatgcatcggtcggacaggcctttacacagcgtccgcagttgttacatttttcctcatcgagaacgatttttccgtccacggtgctgattgcatccacgcggcaggtcttctcacagatcccacagttgatgcaggctgcttcctcccattccacaatagatgcacccttgattccgacatcattttcttctgcctttaagcagttgttctggcatccggttacaccaaatttaaacttatgcggaagttctcttgcaaaataacgctcatccagtttttttgcaatatcataactgtcaatatttccactagggcataccgccgatccctgacaggctgtaatcgtacggacacgcggtccacacacacccggcttacatcccccggttgccagcatttccttaacttcttctacatcgtcaagtttgataaatgggatttccacactctgacgggaagtcagatgtacgtgtccgtctccgtatttttctgcaacctttgcgataatctgtaaattctctgctgtaagatttccacctaccacagccagccgcagggaaaaattatttttttgtttctggcgcataaatccgccttttttcaatgtagcataatcaacagccattactctctcctttaaaccttgtgtatttttctttgtttatccggcggtattttggattgctgctgtaaaatcctgcttcagatcttcgatatcctcaataccgacacttattcttatcatatcatcaaatacggcggcgtcaatcttttcctgctcggttgagtgtgccgccagtgtggattccggatgtacgatcagtgtcttggtatctccgatattggatacgatctgcggaatggtcagcgcattcatgattgcaaaagcgcgttccttgcttcccacgcgaatggttaaaattgctccaaatcttccattcagcaactgctttgccacaccgttccacggacttgatgcaagtcccggatagtttacgctgattcccggaatggtttccagataagccgcaagctgcattgcgttgtcacacgcccgctccatacgaagccccagtgtctccataccaagcagattatagtatgcagtctgcggcgccatacaggctcccatgttgcggaacaatccgtttctcagttttgcagtaaaggcaaattttgcaaactttttatagtctttcatgcccggataccgctccagatcccatttgaatcttcccgcatcggtgatcacaccactgatggcactgctgttgccgttgatgtatttggatgtggaattgatcacgatgtctgcgccaagttcgagcggacgaacgagaaacgcggtagctaccgtattatcgatcatgagcggaagattgtgccgctttgcgatccctgcaagtgccgggatgtcggtcacatccagctttggatttccaatcgtctccgcgaagatgactctcgtcttatccgtgatcttggattcgagatctgccagatcattcgtatctgcaaaaattgttgtaattccaaacgcttccagatcgtggtaaagatcaatcgttcctccatacaggctggtgcttgtgacgatctcatcaccacttcctacgatattcagaagggcattggtaattgccgccatgccggatgcacaggcaacggatgccacgcctttttccagaaccgtcatgcgttcttcaaatgctgcgatggtcgggttattgattcttgtgtaagaatatccagcagctttgttgtgaaacagcttctcatgctgctctgccgatggctgaaagaaagcactggactggtacaccggggtaagtgtggctccggtcaccggatctccggtttttgtaccatgtagtagttctgtgttgaatcccatttcatttcccctaattcatacttatctaataggtttaatatgttatagttaatataccgcaatcataccctattgtcaaccttttatttccacttatttttccagcaaaaaaatccccgctggtgaaaaccagcagggattccattctcataataaaattactattctgtccagtgctcatccttaaatacgatgcggcggtaagtctcaaaatcaacccacttattaaagaagttctcagaaatctcactgccctctgcggaaagctccttcttgaacgcatccacatctgcggcacttgttacatgaactgcaaatccacggccgttgacgacaggcacatcgttgtatgcaaagtcagcaagcggaataattgcagtaaccttctggtcacggatggataccgctacctgctcacgcagaacaaccacatcaaagctgtccggatactgatacgtctcacccttgaccggaatcacatcaccgatcgtgtaagttttatcggaaggctgtaccttaaagacgttcatagcctcaaggtcatagtaatattcctcgaagatatctccgtttgccttgagatttccgtgggcaaatgcgcattttaagtctttcgtctcatcgagcgttggattttccacaacaccacatgcggaggtcatgttggaaatacggtcaatcaggatcagttctcccaatgtcttatgctttgcaaaagcatcaatgacgatctcttcctgcaataccagatcgcagaccgcaatctcgttcttgcgcaggcggccaaccggaataaattcaccggtgttgacatcaatcttgtactggatattctttaagatacccggaatcgtacgtgtaccgagttttacgagataatctttgccgacggtcagttcctcatcgtccatccagaggattgttgcggtaaatttcttgctgaccggaagcttcgtatcttttgcgagaacacatccgcgggatacatccacttccttgtcaagctggatggtaactggacggcctgcatctgcagtctgtgcatctttatctccgactaaaatgctctttacttttgcatgctcattgcttggcagagtcacgattgtatcaccgaccgatacagcgccactctcgatctgtccctggaaaccacggaacgtgtgatccggacggcagacacgctgtaccggcatgtagaagccttcttcctgcttcttttcgctcacatcgatattctctaagtaagcaagcagtggctcctgcgtgtaccatggcatattgtcggaatgggtggtgacattgtcaccctcggttgcagaaaccggaatgatcttgacacttgctaaatgcagttccttggaaagttcctgaatctggtcaacgatctccttgaaacgctcctcactgtaatcgacaagatccatcttatttacagcaaatacaaagtaacggattcccatcagtgcacagattctggcatgtcttctggtctgtacgagcacgccctgctttgcatctacaaggataacggcaaggtctgcaaaggatgcaccgactgccatgtttctggtgtactcctcatgtcccggagtatctgccacgataaagcttctcttttcggttgtaaagtaacggtatgccacatcaatggtgataccctgttcacgctctgccatcagtccgtccagaaggagggagtaatcgattgcgccgccgcggcttcctactttggaatccagctccaacgctttctcctgatctgcgtaaagcagtttggaatcgtataaaatatgtccgatcagtgtggactttccatcgtctacactaccgcaggtaataaatttcaataatccgctcattttagaaataaccctccctctttcttcgttccatgctgccggctgcctcgttgtcaatgacacgggtggtccgctcagactctacagcactcaaggtctcgtcaataatctcatctaatgtggtcgcgttggattcgattccaccggtcagtggatagcatcccaaggtacggaaacgcacattcttgtattcaattttctcacccggacgaagtttcagacgatcatcatccaccatgataatctgtccgtcacgctcaatcaccggacgctttgctgcaaaatacagcggcacgatatcgatgttttctctctttatgtactcccagatatccgtctccgtccagttggaaatcgggaacacacgaatactctcacccttgttgatcttggagttataaagtttccacatctccggtctctggttcttcgggtcccatgcatgattctcattacggaaagagaaaattctctcttttgcacgggatttttcctcgtcacgacgtccgccgccgaatgctgcagtaaatccgtatttattcaacgcctgttttaatgcctgtgtcttcatgatgtcggtgtactggctgccgtaatcaaacggattgatgccacgctttacaccgtcctcgttgatatactcgatcatgttaatcccaagtttctttgccgtctcatcacggaactgaatcatttccttgaatttccatgtcgtgttcacatgtaaaaatgggaatggcggcttctccggataaaatgctttcatggcaagatgaagcattaccgaactgtcctttcctatggaataaagcattactggtttttcacactctgccgctacctcacggataatgtagattgcttccgcttcgagtgcatcaagatgagataattgactcatgatcttcctccttaatatttattcgaatcctttttattcacaacaattgtttctattgtaccatctgtttttttaattcgccagtgtaacagatctccttccgtatgaacggtcatctggcttcccatgccgccgatgtcggcacccaggtaataggaaattgcctcaaacggacactccttgatacaggaggcgcatccccagcagtccttcggataccggatcacggcttttttgtcttcgccgcgcacgatcaggcttcccggacagacatccagacattttccacatgccctgcatttcatggaatcaatcgcgatgctcataggtttctcctcctttcaccagatctctgcggatcatcgtaatctggtccccgttctttttcgagtttacatagcagagccatgcatcactcttctccggataatccagattctccgcgaaactgtgccagcgtgtctccttgcgtgcacgcagatgtgcgatcacagtcaggcacacggtcagacgttctttcagctcatagataaacatcagctcatgcatatcggctgccgcaagtccttttgcaaggatctgcagtttctttattttttcttccgccatggcaagctgcttttcgttgaactggtaatgggttccgattccgcctgcatactggtccatgactttctgcatggcttcctcgagttcctcaacggtaaatgccggggcctgctttgtgagaaatgcatcatactcggcaattttattttcaagaaccgcttcttcatcagaagccgccgtatctgccacctgttcttcgtttaatttctgcacgatggaatgggctgcgatctcgccctccaccagtgcgccggttacatatttctgtggacagccgcctgccacatctccggcagcatagagtccgtggatcgttgtctcacgttcggtgtctacccagtaaccgctggcggtatgaccacctacgatgtacggctcggttccctcgatttccacgttctgttcgcttggatttttcccggattccacccacttaagcgtctgtcccggcgccatgtttaagtatgcttttaagagcgattcatcctgttctgcggagatgccttcggtgcgaagataacatggtccgcgtccctgtacattttcttcaacagttccgtacacacgctgggaagtagtcagaccgtattttgtctcatacacttctccgtgtgcgttgatctgctttgctccgacaccctgtgcaatcgttccggtcggagcgatcgtatctttacagcgcagggcgataaagcgcatctcaaatgtggtcatctcggctccggcttcaattcccatggcatatccggcaccggtgttaaacggcggataccacattttatgacgggaaaaacccggattgttcgggcggtaaagtcctgcggctcctccggttgcgatcagcactttttttgcgcggatctcataggccgtaccgtctgcaatggaaaaaccgacggctccttcgatcttattattgtttaccagataatcggtgatgtttaactggttgatgacggtcacatcgtctaatttgctgacagcatctgcaagaagcggcttgaagttttcgccgttgatcttgatattgcggtttcctcttgccacatactcgccgttttcgtcttttaagatgaccagaccaagctgttccattttggcggtcacacggttgagtccttcggacatggtcaaaagcagatccggacggacgatgccgtcggcatcttttgtggcgtagtccacgtaatcctgcggaacatgacctttggtgatataggcattgagcgcgttgactccggctgccagacagccgctgcgcttgatgttggctttttccgctatgattatggaataatcggattgttcacggatggtcattgccgcgtagcagcctgctgtgccgccgccgatgatgaggacatccgtatggagtattttttttccctcgattttcataagtaatccttccttgtgattaaatgtagaagacctcgccttcctgcatctctctattttctacgagataggtctggttttcatcaaatatgtaaagccggtagattaagacatacactttttcaccgatctctaccggatctttttcaagtgagcgctcggtgacgatcgggatacctcccacatcaacgacaacatccagatgatttcctcggaatatcacatcttttacgattccacgctcggcggcactcatatgctgcggtggctcgcttctggacatgcggacaaattccggacggataactgcgtgggttgcgccctcgaccggatcaaatccaagcagacgctcataatgctctacgatcgaggaacggccgataaactgtgccacgaacggggtgtccggtgatttataaatttccatcggtgttcccatctgctcgatatgtccatggtttgtgatgataatctcatcggccacctcgacggcttcatcctgatcatgggtaacaaaaatgcttgtaatgccaagctttacaaccatctcgcgaagccagttgcgaagttcagtgcggacttttgcatcgattgccgcaaacggctcatcgagaagaagtacctgcggattcggtgcaagtgcgcgggcaaatgccactcgctgacgctgcccgccggacaactggttcggataacgcttttccattccgcttaatccggtcagttccaacagttcggtcacgcgctttttgatttcttttttcggcaccttggcaagttcgagaccaaaagctacgttgtcgtagacggtcatataacggaacaatgcatagttctgaaagacaaaaccgatgcctcgttttgccgccggcacatcgttgacacgctgcccgtcaatatagatatcgccactgtttggtgtctcaagccccgcgatcatgcgaagcagtgtggtctttccgcttccggaaggtccaagcagtgcgactaattttcctttttcaatgccaaagctgacatggtcggaagcccggaagtttccgtaatttttacaaatatctctcatttccacgtacatagcctgactccttactgtatccctttactgtttttgcttctgtattcaaaaatgtttctgagtatcagcacgatcaccgcaataatgaccagaatggaagatactgcaaatgcggaggtgatggaagtatccgtccccgacatatataaggcatcaatctccagcggcagggtaaatgtctgccctctggtctttgagagtgcattgactgctccaaactcgcctaacgcacgcgccgtacataaaatgataccatagatcagtccccatttcatctggggaagggtaattttccggaaaatcgtaaatccgtttgcccccataagcgccgccgcctcttcctcatcctttccctgtgcatttaagatcgggatgatctcacgcgatacaaacgggaaagtgacaaaaattgtggcaagcaccacacccggtaacgcaaacgtaatgcggatgtttgttccaaaaaactggttgatcgcccggattgccggatacgtccagccgagtcgtccgaaggtcatcaaaaaggcaagacctacaatgacgggagagatcgaaaacgggatatcgatcagcgtggcaagcacctgtttcccacggaaagaaaactttgtcagaagccatgccgccatgattccgaaaaacgtattgacaactaccgcgatcacagttgcaagcaatgtaaccaaaagagccgaacgcacatattcggttgtgaccgcctgtatgtaaaaagcaaatccttctttcaatgcactgaagagaatcgaaaacaggggaagaatcagcataacaaatatgaaaagaacgctgatggctattaagatatatttcgtacttttcttttgttccataaaaacgaacttcctttcttaaaacaaactggctggtttcccgttgtacttacacattgttggttctggctgcctgtttcatctgtacgatattcacagcaagcagtaaaacaaacgataaaatcaacattaccagcgcgattgccgtggcactcgcataatcaatatacccaagcttctgcatgatcacataggagatcacctgcgtatgttcccttgcactgtttccggatatgtaaatgacacttccgtactcaccaatccctctggcaaaggcaagcccaaatccggttaaaaccgggggcatcatctccggcagaagcactctgcggaaggtctgaaaccggttggctccaagcataaatgccgcttcctcatactgtccgtcgagtttttcaagcaccggctgcacggcacggatgacaaacggaattccgacaaacaccagtgcaatgaccagtcccagatgtgtgtaggatactttgatgccaagttttgcaagcggagtcccgaggattccgttttcggaatacattttagaaagtgtgatacctgctaccgaagtcggcagtgcaaacggaagctcaatacagccatcgaggatacgttttcccggaaactcatatcttacaagcacccaggcaatgatcacaccgaacacactgtttataagtgccgcaataaacgaacatccgatgctggtcgcaaatgcatgccgcacggtcggcttcgtgatcagggaccagaactctgctggacgcagttttaatgcggaaaccatcacagatgccagcgggatcagcacaatcagggaaagcattgtcactgtaattcccaatgtgaggtgataccccggtatcacacgtactttttttgtcttattcgttgccgtagatttcatcaaacattgctccatcgtcaaaatagttcttatatgcttcgttccagccgccgtaatctttgatcgtatataatttcacattcaggtcaaaacggtcggaaaattccttcagaattgattcattgctcggacggtaaccatactctgccgccagccgctgcgcatcatcggtgtacagataattcaggtactcgcggctcacttcctgcgtgccgttggcatccgcattgtcatccacaatcgccacactcggttgtgccagaatactgacactcggcgtaatcatctcatattcatccggataacttttcatcgtggtaattgcctcattttcccacgcgatcagcacatcccctttctggttttccacaaacgtggttgtggaaccgcgcgctccggaatccatgacggaaacctgcgagtaaagtttctgcagaaatgctttctgttccttctcatcatcggtctgctcctttatataggaaagtgctgctaaaaagttccagcaggcaccaccactgctctttgggtccggggtgatgatctcgacctttttatttaccagatcgtcccagtctttgatctgtttcggattgcctttccggacgaggaaaacaatcgtcgaagtgtatggggaactgtcatcagcaaattcctgttcccagcctttaccaatcagtccggtctgctcaatcagtgtgatatcatgctccagtgccagtgtaacgacatcggcgttacatccctccacgacggaacgcgcctgtgcaccggaacctccgtgggattgaataatatccacttcttttcccgttttttccttataatatttctcaaacagaggattatatgcttcataaaattctcttgtcggatcgtaggagacgttggtgattgtccgtacatgactttttttgcttccgcatccggtacatccaatcaacataatggctgccatggacagtaccgctattttctttacaattgaaaatgattttcgcttcatgctcccgcctcccttgactttcgtttatcataccccttaattcctatcatgtcaataggtattgtaggaataattttcctttctttccacagtaccatggaaagattgaattttgcttgaatctcaatgccgggatttttatggacaattaaattgctggttaactgcgtggtctgggaccttttgagtttcttaaaagggacggatttgcggagattgttctaaatataagttttttcaatgcgacggaagaagggggacattctctttctacagaaaaatttgcaagttagctctggcgttggtttcaggtacgtggagtaaaatttttcaatttacgcaattcactatgtgggttgtgagtgccagagcaagttgtaaatttgttcttccgaaagaaatgttccccttcttcctgttagctggagaaaatataattgagaaacatatttccgcaaatcctgtctgtggaataaatataaaggcaccaaaacctacagttaaaggcgctcccggaaggaaatgcatacaatgagtgtttacggtaaagtgataaatgtttgggaagcttaacatgcaaataagtggaaatttcattgctggtattttgtgaaacaatcgttctattgaagcttttatatgatcgggcattatgaacttataaatgaaagatgggggctatataatcaaaattcataggaaaaatgccatcgtggtatctatgccaataaaattcacgtaaaagataccattgcggtacctatatattgaaaatttaacattcagataccggaaagtctctatagatcaaaaattgcttctccagatactgctttatcgaaaaatgcggtatctggagaagcaatttttactatataggtgacatttcctgatttcaagcattaaaatttcggaaaaccgtcacctaaaactttaatttttcatctatagatacccggccttctcatcaagtgatttaacagggtatttttatgcttattccagttcatgggattcgtagctgcttttgaggcatccctttaactgctggttctggtgcctttatatttgtcacatagacaggatttgcgggcatcattcttttacttatagttttccaatccacaggaagaagggggacatttctttcggaagaacaaatttacaactgcgccgtagttccatcatgtaacgctaatagcataaaagtaaaacttttgcaaaaccagcctgaaatcaacatcggcgctaacttataaatttttctgtagaaagagaatgtccccccttcttccgtcgcatcgaaaaaacttatatttagaacagtccccgcaaatccgtccctctgaaaaacaaaaggccccagaccacgcagttaaacagcaattcttcaaaagaagtttccatcactcttccctggtcaattcatatgtcacctccttgttctttgttcgcataacaatccctctgacatcttccggattaattttatttgccacctgtaatcccagataagaggtcaccctatagaaatctcctgactgtaacactgcattgcagtcggaataggttttctttgcctttgaatcactaatgatatccatcggataaggatctgcaatattccagttacgcgttccatctttgtaaatcaaagaggtttttccaagatcctctcccacactttcctgattctttccccatctctctaagccaaatgaccattcagcatttttctgcatttttctgtaatactctgtagttgttccataaattacagcactcaatggtgttagccgcatccgctttggctcataatacttcggactgatctgctcctgattttttgctttcaacgtatattcataaacaggaacattacagctcgcgtcaagtgtcgcagtattattcgttcttgtaggcaaatcataacacaatgtcaaattcattgacgatggaatccattgtcgaaaatccatgtccattgcaaaatactgcacattcttatcactttgtgttctgagataaatagatgaagattcaaaacgctcttcatacacgttctgctcaagacgcaactgtcttttcgaacgaagatttccattttcatcatagctttccgatcccgccggtcctttggttgccagccatttttctccggtttcatcctttgcctcatagcgcacaactgcacttacaacaacttcatccgaaaggatttcctctaccgaaaaaatcatatgttcatcctggtcactgaatactcctcttgtaacataatcggacaattcacttcgctgtccccaatacccctgaaacatcttttttagctgctccgcaaaagatgtctgcggaacaatgcaggcaagtgccagtgcagccgccacggtacctgcaataccggccattttcattcgtcttttcctcatcattttttcctcctttcgtctctttttgagtacaatttcctcctctttgatctcccgctgcggtgtaagggccttttttaaaatcttatctaattgctcatcgttcatatccgataacctccagtttttcctttaaaagtgattttgctttgcgtagacgggttttaacggtattgacggaaagatgcaggcactccgcaatttctgtcagtttcatatccgccgaataatacagatacaccaccagccggtatttttcgggaagctgctgcaccagtttctgcacttcatgtattgtttcctcctgcaatacctgtacttccggatctgcattccgggtttccgatgcttccccgccgttttgtatatgtacttcgtagctctcctgtggtgcaatccgcatccgccatgcaaattttcgtctgcgatttttccagagccggattgccacagaaagtgcataacttttactgttatttttctcatccagccggtctaaatgttccagcagcgtaagcatggtatcctgatacagttcatcaccctcatgggcatttcctgcagtcatcctgcaaaaccacaggatatctctcccgtgcgcaagcacaaactcatcaaacttttgttttgtcacgtgtaattcctttctattccccaaagacgtccatgagatttctctcttacataatgatattgtaataaattttcaaaaagttttccggatttattggcacttgaacaaatacgttgaatactctataataagtagaaaacctgtgccctgcggtacatttttaatgtatcccaatcgcatctggctttttattacacattacgaggaaattttatgaaaaaaaataccctgcggcattcccttctgctgcttctgactgcagctatctggggatttgcctttgttgcacagagtgtgggaatggactatgtgcagccttttacctttactgctgcccgctcactgatcggggggatcgtactgcttccgtttatttttatccgggcgcagaaaaccggccggacttctgaggaaaaatccgcttcctggaaacaggcactgcccggaggcatcatctgcggtgttctgctgtgtatcgcatcgaatctgcagcagatcggcatacaatatacgaccgttggaaaaagcgggtttatcacagcaatgtacatcgtgcttgttccggtactcggtatactttttcacaagaaaaccggtatccgtgtgtggatctctgtggcacttgctgtatgcggactgtatcttttatgtatgaccggaggttcctttcgtctgcagcgcggagatctgtatacactctgctgtgcgctcatattttccctgcagattcttgccgtggatcactatgcaccgatcgcggataatgccatactggcatgcatcgaatttttcacctgtggcatctgttccctgatcccgatgtttttactggaacagccacggatgcacctgattcttgccgcatggctgccgatcctgtatgcaggcatactctccaacggtgtggcctacactctgcagttttttgcacagcggggacttcctgcctctacagcctctctgctaatgagcacggaatccgtgttctcgcttctggcaggttttctcatcctgcaccagatgctgaacggtcgcgagcttgccggatgtgtactgatgtttgccgccattattcttgtacaaataaaaggaaaagaaaaggagtcgattaattcatgaaaaatatcattgaaaacgaagtcggagccatcctgacagatatccttgacgattataaaaaaggacgcgcagttgataagatggatatctacaaccagccggataaaaccgaaattatggacattcttgaccgtctgttttccattgtttatccgggatttttccgcgataaaacccacaaaatctacaatattgaacacagtgtgtctaccatgattgaagatgtaatgttccacctgaacaaacagatctgtgttgtcttaaaatatacgaaagaattcggggacaatgaggaagaaaaactggaacagtttgcacagaaagcaaccgtttctttcatgcggcggattccaaaggtccgtgaatacttagagacagatctgcaggccgcttacgatggcgatcctgctgcacgcagcaaagacgagatcgtattttcttatccgggcctttatgccatcacggtataccgtctggcgcatgagctgtttctgcttggtgttccgcttatcccgcgtatgatgacggaacaggcacacagcaaaaccggtatcgacatccatccgggtgcaaccatcggcaaatatttctttattgaccacggaaccggcatcgtaatcggtgaaacaaccatcatcggctgccatgtcaaactgtatcagggtgttacacttggtgccctttccaccaaaggcggtcagaaactgcgcgatgtgcgtcgtcatccgaccatcggtgacaatgtaacgatttactccggtgcttccatcctcggtggggaaactgtcattgaggagggggttgtaataggtggtaactcatttattacccagtccattaaaaaaggcaccaaggtcagtgtccgcaaccaggaactgatctaccacagtgatgatgaatcacttcaccacaaagaacaggatgaatcctggttttacattatctgatagttacaaaaggggattttatggatacaaaagctttccgggaaggattccgcgatggcattcccatcggacttggatacctcgctgtttctttctctttaggtatttctgcaaaacaggctggtctgactccgcttcaggggttcgtgaccagctttctggaaaatgcatcggccggcgaatacatcgcatttactctgatcggtgccggtgccacatatattgaactgtgtctgatgacaatcatcgccaatgcacgctatcttctgatgagttgtgccatgagccagcggttttcaccggatacccctatgatccaccggtttcttgtcgcatttgacctgacggacgagctgttcggcattgccatcgggcgtcccggatatctcaatccctactacagttacggtgcgtttcttgtcgcacttccgggctggtcgatcggaaccgccgccggtgtcatcgccggcaatctgctgccgggcgatatggtaaaagcactcagcgtttctttgtttggtatgtttctggcaatcatcatcccacctgccagaaaagacaaagtcgtgctggtgttgatcatcatcagttttgcagcaagttacctgtgcagccgtctcccggttatccgtgacatttccagcggaacgcgcacgatcatcctgacactgatcatcgcaggaatcgccgcatggcgtttccctccgcagacggagatcactccggaaaatgctgacgcacaaaaagaacagggggcagatgtatgagtggaaatatttatatctacattgcaatcgtagcgatcaccagttatctgatccgcgtgcttccgctgacgctgatccgcaagccgatcaaaaaccggtttatccgttctttcctgtattatgtaccctatgtcacacttgcggttatgacctttccggcaatcatcgatgccaccgccacaccgcttgccggagcgcttgctctaattgtcggcatctttatggcatggaagggactcggacttttcccggttgcgatcgcctgctgcatcatcgcttaccttggcggactgattttttaataaaaaaatgcctgcatcattttttgattcaggcatttcttctatccccaaagtgaaaataaaaatactacgattccaagaatcacaagaatcacccccgtcacacggttcagcgttttcggtgtggctttatttgcaaataccgcagcaattctcgcccagatcagggtaaaaatcacacacagcgtaaacaccagtccgtccggtttcccgccaataacaaaatgggacgctgcccccgtaaacgcagtaaatgccataataaatacactggttccgactgctgtcttcaattcatacccaagtacagaagtcaggataagaagcatcatcatgccgccaccagcaccgacaaatccacagataaatccgatacagataccgcttattaccgactggatggcacgcttttgtggggataccccctgcatggtctctttggttgtcataaccgggcgaacaataaatttgataccaagtaaaaatgtcataaaaacagaaaaatttcccatcgtggtggatggtacaagacttgaaacatagcttcctaccacggtaaatgcaaggacactgaccatcatgatcagaccatttttcacatcaagattcttattttttccataggtatacgcagacactgcactggcaagtacatcagaagacagcgcaatcccgaccgccatatacggctccatcccaagaaatgtgataagcatcgggctgataaccgctgccgcactcatcccggcaaaaccggttccaagtccggctcccatacctgcaaaaaatgttactagaatcgtaaataatactttcattctcctgtatctctcctttgttccagataacaagtaattttagcacatttttcaaaacaaatccagcatgttatccagataaatttcttcccggacatgcagctgatattgtggctttgtcatgtaatatagcagaaactctaaaatcagtgcacttccaagtccccgtccctcgatcttaaaattagaaaatcccattggaaagtaaacattttggattgcctctattccaataaatcccggattttgcatggctttggaaaagcaatatccctgctcagattccggtgccgtacagtgatgttccctattttctccaagattcttgcggctgaccgcttcataacaggctttcctgtccttacagccaaaccagcagcattcattgcacaaaaactccaccttgtctttttctggccaagacagtgtcttccatcggtcataggctttatttaagcgaaaatcaggaacaacataccggaaatcttcacgtcgtatttcctctaccagctgcttaaaatccgtgattacttttgtggtggacgaaacaaaataaaggtgcggataatgttttttcagatattccaacagcagatccgaatggacaatcacaccgttttgcacatctttattttcttccagtaaagcacagagcgcattgcatttccggtcagaaagatgcttctcttttaaaagagagttgctgaaggtcagccgcgcggatactccatactcctgcatcagtgccagaacttctttcggatcattctctccaaaaccggcacgtccgccgccccagatacaatctgccggagctccatagatcgaaccgatttcacaccagtcataaaaccagtccctgtgctcccgatataacggaagaaacacgcggtatagttcataaaattcaaacaagcccggaaggtgataatacgcttttaccattctgtacattcctctcattttttatcataacggttcagaccacctcagaatagttactttattaaatacaaaatcaacccggacatcaccccgattccaataatacagataatcatacctccaatgaccgtcacagttcttccttcatccgataattccgcattctgaaactgccatctgcgcagaaaaaagtataccttatccggataataaatctgtacgattccaagcacataaataaggactcccaataccgtaaatccccaaaatgaaatcgactccagattgccgtaaaggatgtgtcccaatgcattgctgtatgtttcatcactgatgacaggcttttcattccctgctataatctgcatttcatcccagcccacagggcttccatctgccgcgagcaactgatcccccgtccatgtgccgtttatcgtatcatccgcaaatgaaaacgtgacctgatcccctttcatggtataggaaacattctgtttttttccatctgccacaagtaaaaaagtatcatcttttgttcgttcaacatagttgactgtgttgtgcacaaacttatctgcacggactttgtaataaaaatcatccccaataaaaacgccttttcgcagcgtaaaatatccaccgattgcaactgcaaaaatggcaattataatcaaaaaaacaagtcccaaatgctcttggattttcttcatttccgtcctccttctctttaaaaaaaagccattctctcctgcgaaaatggcttctgaaatactactacttattttcaaaattaacactgcggatcatgttacggttgataaactgtgttccctttttcggtgtctcgatcttcacccactgcgcatccacgtccatcagttttcctttgataccacccatatcattaaataaacttaccgcacaatcttttcctatataagtatctaaaattgaaccactcatcatttcgtcttccttcccattttctgtcactgtaaacagctcagtatcctgcattgccagcatattccatgtatttaccatattgaaataattgactgctgccattgttgttgcgatatccataccttcatcacctcatagatatcagtgtagcattctttgtgcacacttgcaattactttctccctctttccctctccgacatcggaacttcatttttcatgtaagtatcccacacctgcatccgatcctgctcatccagtttgcgcaaaacttttgccggaacacctgccacaatacagttatccggaacatcgcgggttacgactgcccctgccgccacaatacagttctttccgatggtcactccgccacagatcgttgcactcgaacaaatccagcttccgcttccgatatggatgggctttgcatactccaggtcatgaaaaccatccggatactgctgcggcagccgctcatcggaaagaaacggatgacacggggttgcaatcgtcacgtttgcgcctacccacacaccatcctccagcgtaatcggcgcacagtccagaaatgtacatttatagttgacaaaacagccttttccaaaatggatattgacaccatattcacagtaaaatggggcaaaaatggctgctcctccatcctttgcagatggaatcagtttttctaacaaacgctgttttctttttttcctccacagcggagtgcggttgaatttatcacaggtttccatgccaaatttatgatattgttccagatctttgctgtcggcattgtaaagtctgccggctttcattcgttcccagttattcatgtttatctccctcttttttatttcctttagtataacaaacttttgcaatacaggaaactgaagtttggtgactatctggttctcttaggtgctattatgcgcgaggaaatgatgattgactagctaaaaaaatgtatcaaactgctcggttaacatgctccctctcccttcaaataggcgatcacttcgaatagatccggtaacaccacctctgctttttcctgcatttcttcatttgcaggcagcagatccggaaccatgatcggaagcaaatgtcctgcatgtgccgcacgaatcccattgtaggaatcctcaatcgcatacgcgcgctccggtgcaaccccaagttctgcacaggcctttaagaaaatgtccggtgccggtttgctgtgctccaccatatccccgcagatcactttgtcaaaaaaatccaaaattccagcatcctttaactggtttgtcacggtctgtctgcgtgtcgaagatgccagcgcaattttctttccatcttcttttaaaaaggtgagcagttccacaacccccggcttcatcggaagcctgccgccatcgtatctgctgtgatagatagcagaggactctttcgcataaatatcatacggaaaatcctccccataaatttccagcataatctcccgcgtccgtttcatcgtcgtccccgtacaggaaagcaccgctttctcaatatctggaatctggtatttatctgcaagctccttccagcactgcatcacagcccgctcagaatcaaaaatcacaccgtccatatcaaatacaactgcatcgtaaccggttttcttttccataaaataatttcctttctgtcttacgtgacaattttattctaacacgatttatccaattagtgcatgatagattctcagatcatcgtccttgaatacgttaaatatgactttttttattctgctgtcctcattgatataattctttaccgtctcggtagcgatttctgccgccctttgctgtggaaaacgaaacacccccgttgacagacaacaaaaagctacggactctgctcccgtgtccgccgccagcttgagacattctctgtagcagcttgccagcaattcttcctcttttcctgtaacctcccactgtatgatcggtcctacggtgtgaagaatatattttgccggaagattataaccggacgtaatctttgcctttccggtttcttcttcatgtccctgctttttcataatttcatacattttcaggcgaagttccatccctgcatatgtgtggataaccccccctcgataaaactttctaatattgctcctcgttctatcagtctgtgggttcgcttttttctttcttcaaggcttgccattttctttaatttcttctcttgatttttaagctgagataattgcttttcatatttttctttttcttctttcttgctttcaatctctgcttttaccttttctaattctgttttattgttcataaaaatcatctcctttcatatttttggcaaagaaaaaggctaaataccttttcagataaatagccttttcatttcaattttcagttatatattctatttattagttaatttagagagtaattctgaaaccatttctgtaaattcaaaaggctcaatattgatgccatccattacataagtatgtttgttaagcttaaaaacagctcttgttattatcttgtcatcaacatttaaattttcagacttagataatttcacattaacaccacataatgtcgacatttttgaatcctttaacccataatcaatgccggtttcgttcttgtcagcgataataacatcaagaatcttatcgttattatcttcatttactaaatggacttttatatatgcacgctctgtataatcgtctttattatttggttttactaaaatttcatacacagaaactggattatatttttcaaatattgacaaggatgctaaaatttctttcccttcatctccatctaatgctacttctttagcatctattttaggcatcgacatttgattatcattaaatactaaacaatcttttttatacttatcatatagctttaagtattcaattttcgattcctttctcttttccttgacccataacccaaatgcataatcttttatctctttgttcatccgtttcattagctcagagtctgaatatttgtctaattctccatgaagctctttctggcttttaaaagattcgataagattggcgtctattttcacttcttgttctaacactttgttttttgtacttacaaacaacaatctatcttttaatttttgtttcagagtcgtttccccatagattttaagagctttatcataggcttctttgttaatggcttcatactcgcaaatagcattatcaatttcggattcagaaacaaaaactcctaatttttctgcatatgatgttgccactatttcatctatgctattttcaacaatatccgaatatgatacacctacttttccaaactgttgcagaaaaatttcatcgtgataaatgtatttatcatttactttcacaatggcaccgttaatgttctcattctttacacttaaattattatctgcataagcacttttataagaaacattttcattcaaagtgcatccatgtagcaaagcagaaaatataattagtagtaagggcatcacgaatctattaaatttcattagatttctcatagctggtctccaattcaattttctcactatttattttagcacgcacaattcttatattccacttatgtttttctaaagattttatgggtggactgccatacatagcaatccacccataaaattaccatacttctagattatcttccgcattcacccaatcttgcatctcacccgtcaaagccaacctggcatactcaatagggttgtcaatggcaagagcatttaatgcacactgagaattaggtgtggtcatcaatccctgcctgcgcaatactctgtacgcgcattgcaagatccatccacgaattcatgatctacttctcccgctttcccgctccgacaacggcacttcgtttttcatgtaagtatcccacacctgcatccgatcctgctcatccagctttcgcaataccttcgccggaacacctgccacgatgcagttatccggaacatcacggtttacgactgcccctgccgctacaatacagtttttcccgatggtcactccgccacagatcgtcgcgctcgaacagatccagcttccgcttccgatgtggaccggctttgcatactcaaggtcatggaaaccgtccggatactgctgcggcagacgctcatcggagaggaacggatggaatcattttttccagcagacgctgctttcttttcttcatccacagcggtgtgcggttgaatttatcacaggtttccatcccaaacgaatggtatttttccagatctttgctgtcggcattgtagagtctgccggctttcattctttcccagttattcatgtctgtttctccttttttgggatcgcgtaccttattcttctttctccagaaatgtctgcacattttcttttgtaactttctgatatgcgcgatatatatatttataatttttaaacggatttggattattttcatcctctgtagcaatcgaaaatgcaagatttgccattgctgctgcctgcccttctttatcgttatatacggttgctgcaagtgttccgtcttttaccgcttcaagcccttcttttgtcccatctattccaaaaaataccggccggtttgtttccgtatacccgagcttttcataagcatccatagcaccgagtgccattgcatcattattggcaagaacaacttccatccggttgttatattgtccgatcagctgtatcatacggttctgtgcctgcacacgattccagtttgcaatctgataactcagtttttccagtgcaatcccctgttctttcaggctctccgcaacgctttccgttctaataatggcatcctgatgccccatttccccctcaagtatcacatactggatctttccatcatgattacggtccacatccggatgttctttgatataatctgctgcaagctgtccctgcatctgtccggattgttttgcttctgctccgacataatataactgatcccactgcatcaggtcttcttccacaggttcccgattaaaaaatataatggggatatcgtgctcctgtgcggctgtaatgatctgcgacgggtccgtccggtctgccagattgacgcacaaaatatcacagccattaccgatcatttcctgcacctgatcgtcctgcgttctttgcgaatttgcagcatccataatagtcagactgatatcatatccccttttttccagtgtcctgcattcccttttaaaattttccagaagttcccccaggaaggtatctctctggtcataacatgcgacaccaatataaatctgtttcggtatttcctttttttcgtttccacatgcaccatacaaaagaattcccatcagaccaattaatgccatagcgttttttatttttcttttatccatgataacccctgattttaccggctgattgtaaacagcagattccggttctcctccgaaaaaagattctcccgtgtgagaacggtatacgtaatctgccggtctttcattttatagaaaaaattacgtcgttttttaataagttctgcaacactttcatagcctgcgtcaaactcatccggagcaaccagacattgtgcccatcctgcatccagataataaactgcctccgttgaatttccaattccatagagtaccgccccatacaggtcattatcctttgccgcctccccggcttccacaaagcttgcattatccaaagccatcacgatatccacccttctttgcgtctgtaaattgattttctctttcgaatcattttcttttgatacagaccataaaatttctgcgccactcccctttaatgtatcacaaatccccttctttctttttatcactgcttctgaagtggcatactgcgaatagatcccaatcttcttcccgatcagatttccacggtaattttccagaagcttttgggcaagatccgcacccatatggtaatgatcaggttctattgtatgcaatccggacggttcttcgggaaatgtatctcccacggccattataggaacacttttttccagctgttttagcttttgctgcccatcccggtttgcaatcggttttacgatcaccgcatctgctccttttgcaatttcctgattcataatctcaatctcctcattggcggtttccatattgtccttactgatgatcacaacatctgtatcatattcccgtgctgccattttcagtccgtatttaaacgctgaccactcgctctcatccacatccggtatgatcaccgcaattgtttccggttcatggccgttttgcttatagatgataaagccgagaaccagaatcacgagaattcccagaactgcctctattatcacaaatgtttttttcccatgtttcattttaagaatcctccggcatatggtgttcctcaaatttcctgcagttttcctcactgaaaacaatctcagggatgataactgtcactgtcgttccctcatccagttcactttctatctgaagtccgtatggttctccaaacaataaccggagccggttatttacatttacaagcccgactccggagccttttttatgtacacggtttgtatcctttaataacaggtcaatctcctcttccggaatccccattccgttatccgatacctgcataaagatattttcttgttctttccatccgcgaatgaggatttttccgcagtcatccatctcccttacgccgtaattgatcgcattttcaaggatcggctgtagcacaagtttcacaatacaatcatccagaatatccggacggatatcaaatacaacttcaaacttgtttttataccgcactttttgtatattaacataactttgcgcgtgctgcagttcatcccttatgcggataaccgtatgtccttttgaaaggctgatccggaaaagctttgccagctgcgtgatcataaaggcagcttcctcatttttaccgctctctatcatccaggtgatggagtctaatgtattgtataaaaaatgcgggttgatctggctttgcagcacatcaaattcgctttttcttctttcattctgttcccatatgacttttttcatcagttcggaattctgccggtaggattcctgaatggattgtcccagatgccggatctctgttgagcctccgattgcaatcttttcttcttttccttcctgatattcacgcaccgagtgatccagcttcataatcggccgcgatatccgcacggaaatgatgcggtttacaaatacaagcatcattgccataagcagtaaaataagcaggacaaactgctttacatcggccatcttatttgtgaatatttcatacggcataacacagaccaggcgccatcctgtataactgattgcatccaccataacttttctgtggtttttttccaaatattcatcgtaaattttttctttgaacgaagctgcctttacgctgctttctatatccatgccattgtcaattcttgcctgatgcggatgataaataatatttccctcaccatcacacagataaaaatactgtccttttcctgacgtattgatccgttccatcatacgtgaaatcccggaatagtccatatccacaagcagcactcccaactgtgtatctgtcccattcgtaagttccacgacacggctggaagaaatcacccagtaataccgacaggtaccgtcatcaaataaattctggacatggggtgtggaaaaatggatattctccatacgtgtttttgcctgcataaaccatccctgtctggtcacatccggttcttctttctgggcaacaaccggctctgctgccataaggcttccgtatccattatatatagcaatgctccttaagttctctttatttgcctcatataaaagatttaaccctttgtggatggattcgttctgttcccggatatcgttttcctttataacatcataatatgcggcatccgatacctgcctcatattcacaagataattttctatggaatccaccgtctgatccataatctttcggttattatccacaatattctgctgtgtgatccccgaaaatctccaatataccatcatgcccatacagaccataattaaggttgatattacagaaaatgcaaccatgatggttgactggatatctcccggtttatttttcatttttttcatatgctgtcctgtattttgaaggggataccccaaactgtcttttaaacacataactgaagtaatttggatcggaatatcccacactctttgcaatcatataacttttttccgcggtttccacaagcatgcgtgccgccttatccatacggtattccgtcaggtatccgacaaaagaattccctgtttcttttttgaacatgcttgaaaaataagaatttgacacgcccagttctttacagatatcgtcaagccctaaatcttcctgctgataattgtcgtgcacatattcttttgccctcccgatcagggatttcttggaatgataccgggcatctgccatgtcatcatgcagcatacagcagaattttaaaagccatttctgcaaaacctgcggttctaaattacacagttcattatacaaagaaccgatacctcccggtatttttgtggtatccatttcattgttgaccataaaatgatacagttcgccaataagttccataaccgccacatgatatttttccaatgatttcagatcatggaaattatgctgcacgtaaacttctatggcatttgcaatatcttcattttctccaaggcagatctttttaaacacattggacagttctgttccctctccagcatccctttggatttttctctgcggaacaatctcttttaaatttattgcccggttgcttccatataaaacacgataggaaaccgcttccctggcactttgatacgatgctgcaatctttgcgatgtgcccgcatacctgaccgatccctatggttacttttgcccccataatatgatggatatatttacagaaacggtcacaggcatccgttagttctgaaatttcttcctcactttttaactgcataatcataatggtatccccaagatagcgaaaacgcttcgcgttccatttttccccaaggttctcccctgcctgccggtctaccgataccgaaagcagccgtatatccatgccctccggaatctggcttgccgatgtgtgtatgatcaggcagcaataccacgggcctgtaaaagcaatctggtaatccttaaaataatgcggcatctcctcttccggaatacgtccttcaataagcgttgtatacaaattcgcctgcagcattggaagggaatccgcataatattttttcaaaagatccgtatttcttttttcactgatctcatagtccagtttctctttcagacgctcaaacacttctgttatttccacagcattgagcggctttaaaatatattcctcaatttcaagatgcacggcttcttttgcatattcaaaatcatcaaacccggtaaaaagcagaatttttgttgccggatactttgcttttatatgtgcacacaattccagtccgtccatatatggcatccggatgtccgtcataacaacatccagctgcatttcttcaagcatgtccattgctttaaatccgttgtttgcatgcccggcaacctgaaagccgagttcctcccatttgacttttttaacgatggcttcaatgacttcttcttcatcatccaccagcaataatgtatacatacctcttcccccatgttattttatttattatagcaatttgtccagataaagtaaaacctttccaacataaaacagagatgccctgcatgtttcatgcatcaccggcatccctgctttttcattatagaggagagtatatgttttattttttctgaacgtatttcagacaatccagtgttactgcaacaaggatgataatacccgagaatacgaactggaggttggtatcaatacccaggattgtgagggagtatgttaatgctgtaaagatacatacaccggtaacaacaccggaaatcttaccaataccaccggtaaatgatacaccaccgacaacgcaggctgcaatggcatccatatcccagccctgtccataagcggcagaaccagatcctaccattcgggtacattcaagccaggaaccaaatccgtaaaggatacctgccataataaatgcaccaagtgttactgcaaagacagaaattcctgaaacagctgctgcctccggatttcctccgactgcataaagatttttaccaaaggttgttttgttccagataaaccatacaatgacaattgctgcaactgcccagagaatgatggtcgggaatccattgacttttggaattaccatatttggaatggtcggctcgatcgctccgaaggaaacaccttttgtcgcataggttaccagtccaaaaatgacaagcatgtttgccatggtcgatataaacggatgcatcttgaatttcgctgtaaaaaatccggctatacttgtaaagaacgtacataatacaatacatgctaccagtgcaagaacgactcttgccggtgtcggtactttcgtaaaatcaaagatgtgtccgaacacaccacctgtatttacaccctgatgcatgataatggttgcggttgtcattcccataccaaccattcgtccaacggaaagatccgttccggtaagaagaatgagtcctgcaactccaagtgccaagaacattcttggcgatgcctgctggagaatatttaagatattgttataggtaagcagcggcgttccttttttgattggagttatgatacataacgcaacaaaaataagaatgatcgcgatgtagagtccattctgtaaaaggaatgttctccggttaaatgtatacttataattttcccatttctgtgcctgattttctgcaaatgtgaatttggacaaccggagcagatcaatcagatgatacttgtaactgtacgcatcatgcttccggtctttgatcctctgatactctttttccagttcaatcttttcattggaaacacggttcttatatacataattttcttctttgacctcggcctgggcggaagtctttgccagagtttctttgtgttccttttcaatctttgcaagtttctgctgatgctcctgcagtgcctgttccttttccgctatacaacttgccttaactgcattataatacttgtcaaaattatttttgagataattttctgctttcccgatcagttttgcgatctggtctttgttctgtgcctctaccgcttttgcctgttcaagctccttctggcaggatgcaatctcagaatctttttcccctttggaaagtgttttatctctttttacgttttcgatcctgctctggtacataatgacttttgccgtaccatcttttctgagttcatcaatctctttttgtatttttccgacatattcctcaatcggctgacgcagtgttttttcctgctccgctgtaagaatcttgctatttgccatatctgtcccccctgcctataaatatttcgcgctgaggcgaagtaattcttcctgattcgtttcctttgtattgacaatgcccgcaagccgtccgttcgacatgacaccgatccggtttgtaataccaaggatttccggcatctcagaagaaaccacgataatggtctttccctgttttgccatctgtatgatcaggtcataaatttcatattttgcgccgacatcaattcctcttgtcggttcatccatcataaacaccttcggttcacgctcgagccactttccaaaaataaccttctgctggtttcctccggaaagacttgaaatcatatcgtttggtcccagacatttggtatgcatgactttaatttcatttgcggtagcctttgtcattttcggttctgaaagtgccgcgccttttttatatgcattaagatttgcaatggttgtattaaatgtaagattccctttcaggaataatccatttgccttccgttcttccgtaataagcgcgaatccataatccattgcctcttttgcacagctgaaattcataagcttatggttcagataaacacggcctgcggctcttgtgcggataccgaatatggtttccagcaattctgtccgtccggctcccacaaggccatataagccaaaaatctccccttcacggacatcaaatgtaacatcctgtaaatacggctcatattttgtggacaaatgctggattgataaaataacatctttcggctgattatccaccggtggaaaacggttttccagcacacggcctaccattgcagtaatcagttcattcatatttgtttcttttgcactttttgtcatgaccagatttccatcccggagtacggaaatatcatcacagatctcaaatatttcatccattttatgggaaatataaataagggagatgccctggtcacgaagcatccgcatcatatcaaaaagtttatccacttcctgtacggtaagtgatgatgttggctcatccaatacgattactttcgaattatatgagatcgcctttgcaatttcacacatctgccgctgggaaacggacatatttctcatcggctgatccagattcaccgtcattcccagtttccggaataattccgaggcttcatttttcattcttccctcatcgatcatcccaagggaatttaccgggtatctgccaagaaagagattatccacaacatttctctccagacactggtttaactcctgatgcaccattgcaatcccattttcaagtgcatccttcggaccggaaaaattcacttcttttccgtcaaggtatatagttccttcgtctttctgataagttccaaaaagacatttcatcattgttgacttaccggcaccattttctcccataagtcccataactgttccttttctcacatcaaggttgatatgatcaagtactctgttgcggccaaatgatttactcatgccacgtatcgataagataatatctttgctctgatcccccatactatccgctcctatccttttgttttcggggagagaaccgcatttctccccccgaagttaagttgttttactgatttaaaagagctgtgtaagaagctgcattatctgttttcaccatgttgatggcaaaagcatcgtactgtcccggattgcccagacggtttgtgatattagactctgtctgtccgtcaccgccaatgtactcaacatccagatttaaaaggtcatcatacttctgtaacagcggctgataagtagaactcaggaagttatcagaagcattgtaaatattcagccataccttctttgtcggatgggcagatgcatctaactgtttggataccggttcccatacaacggtagaatctgtaaaatctttgtagttatcagaggttactgccacgttcagggagtagtaagatctctcatcttctttgtatacataaacgtcactgcttaatacatttcctgcatcgtctgcggttccgatacccgtgtcaacatctacaccatccagtgcatttctaagaacacgcagtgtcaagtatgcctgtacgtctgcatgctggctgatcgttccaccgtagccttctgcaattgctgcaactgcatcgctgtttgcatcatatccgaatgtcggtacgccgttatcctttgaccatgcattaaacattgacattcccattccatcattgttggatacaacgacatcaatggaatccccgaaagaagatgaccatgtaccaatcgcattgccggctgttgctgcatcccatgtagcacctgctgagtttttcatttcctgggaagcaagttcacggatcacataggtttttccacctacttcaatgcttccgtcctgaacctgtgatgcttttccatcggtattggttcctgccggtgcactgtctgcctcgccgtttttatccactgctgttccaagtgcttttctgacacctcttgtacgggcaatggaatcattgtgaccgatatcaccgattgctaaaacatagccgatcacgccatctccgttacggtcaatcttgtcaatatttttctcgatgtaatcttttaccatggtaccctgaagttctgcaccctgatttgcatcaaaccctacataataagtatctttgttaaaattgagtgctgtcatgtcaagctctcctgtagaactgtttgacggctgacggttaaaccataccaaaggtttatccttgtttgcgacagttgaggtagaagtgcctccccctgtattgcctgcctgtgtgccaccgccgttgtttcccccatcggctccgcatgctgcggttgaaagtgcaagtaccgccatcatcataattgcaacaattttctttttcataagaatttcccccttcttgttttgtttgtaatgctagtatacgggatttttatctcataaactatagaatattttttggttcacattaaaaattttcatatttttccgttatttgttcaattttttcatattttttctttgccatttcgtcactttgccgttgatttgtactaaaaaaagccatctttctttacaaagatggctttttaaatcttttataaaaggctctgttatcattgttccagaatcacatgccacgcctcacacagccgttccagcgaccacgcggcatttgccggacttgtggatggaagcaccatcgcttcgatccccgtgaccggaaactggtatcttttataaagctgtcctgccttgtttccgtttgcataaatacgtgttatgttcgttttttccagaatcatgccaatatccgtcggctgtacatttttaatactgctgtcacttgagcctttgatgtcacagctttggatcacatcccacagggcaatccggtgggcaagcagcatggcttttttctcctcaattgtatgcggaaccggctcctttaaaagtgttgcaagcactttccagaaacggttctgtttgtgcccgtaataaaaattgttttctcttgatttgacggacggcagggttcctaatatgaggatttcggaagctttgtcgtacaccggctcaaacgaatggacaatgtgttcatattccatggaattctccttttaaagttaccaccctatccgtatccatcttactgcttatccttctctaagatctggtcaatcgcagctgtcacctttttgtaaacttcatcactcgtgattccgcccatgatcggatctccgacaatgttgccattacggtcaacgagaactgtcgttggaaatgccataatatttgttgcgtatttaccggcctcactgtccgaatcaagggaaaggttggtatagtctgccccctgttttttcaggatgctttttgcttccgcaattccctctttgttaccatcgagtgaatccgtgtttacgccaatgacctgaccgccctttgccttcagttcttcatttaatttgttgagtgccggaagttcctccacacatggcgtgcatccattaaaccagaaattaacaaccgttaccgcattctgtgaaaaaatgctgctgtccaccttatttccatccagatccttcgcctgaaaagacggaaagacggatgtttctgcattcgcgctttgggcgccggaattttcttttcccatctgcgcggtaagttccgttacctgatcctcgattttcttaatctcttcgatatccttatccagctttttcaggtctgcctccgaaaactggtccttcacatgatccagctgtgtctccagaaacgttccataattttgttctcctgcgtctgcagctttgtttttgtcaatgttattaaaaaccgtattccacaattcctgatgtttcgcaataatggcattttccttttcgtacagtttgttgagttctgcattaccagcccctgtatcttccgcagactgtgcctgcgtttccgtcacagtgctgcctttttccgaggcattgccacaggcggcaagtccaaataccagagtcataaccagtaacattactgtaagttttttcattttaattattctccttcttcttttttgatttttccgcaaatccatacttataactgattgcctctaccggacattccttcacacatgctccgcagcgtatacattccgtatgatttggatgccggaccacatccacatccattttacagacaccggcacatttgccgcaagatacacatttaccggtatctatatgcatctgtaaaagagatactttattaaaaagcgcatagactgcgccaagcggacagatccatttgcagaacgggcgataaaacataaggcttaacaacacgaccgcaaccagtattccggccttccatgtaaacagctttcccaatgccgcacggatgcctgcatttgcaatcgaaagtggaagtgccccctctaatactccctgtggacagaggtatttgcaaaaaaatggatcccccattcccagctggttcgtcatcaatataggaagcagaataacgaaaaccaaaagaattccatatttgataaaccgataaaaaaattcggcagatgaatattcgtaagaatcgttgccacagcctgaatccacccacggacatgtgcaagaacatgtgataccttatgctttttttatccaatgccaacacactccagacataatttaattgctttggagagtaccgtggctgcctctccacgcatcgcgccataacaaaccataagcattgctgctgcaaggagcagcagctgtacggctgctttcttttgtagtttcattccctttcattcctttctttttgcttgttacaggttatcagccaactgtgaacgtcctgtgtatgaaattctaagatatccttaagaaaatctgaagtatccacgcatctcccttttgccatgcatctgcgtacctcttctgtatccgaaagtcaccagcttatttttgaaaatttaacactagacaccaatacccggtatgtcacagctgccgaccggcgcaaaatgcaaaatctatacttttttgtatgattttctcccaacctgccagttttatcagattgttcaggtatccgatacaccgattacactttcctgcccggataaagatttgtgtcttctggcggatacgctcaaccagtccctggaacagctccgcgccatgcagcattgttttgaacagggaaacgccaaaaatgcgaccagtcttgggctttcattgcacggacactggtggagcagatgcacgggcagatggatgcggcttataaagcgggaagtcttgtcatccggatacatatttagtttattttatagttctattttcctattgtattgcaaggtctgacatgctatattcgtaatacacatttttaatttgcggtcaaagttatatcccggcagcatttcatcggatcaatcatccgttttcccatgtgtacgaacaaataaatacccggagaagaattcttatattgaaaagcaccgtttttttatgctacaatcaaagtagttacaggtcacaaatattatattatattatcttctccacccacaaaggagaagaagaatgtatttaagcaaaaaatttgaagaccttacgttcagtgacgattttttatttggcattatcatgcgcaatccaaagtattgcaaaccatttttagagaccatactgaatgttcgtatctcgcgcattgaatatccggaaggtcaaaaaaccatcaacttatctctcgatgccaaaagtatccgtctggatatctatgttgcagatcatgccgacaccgtttataacatcgaaatgcaaaaaggattacaccggaatcttccaaagcgcacacgctactatcagggtatgcttgacttagatcagatggataaaggcatggactacacacaattaaaacgaagtttcattatttttgtctgcacctttgatccctttcatatgggcagacacctgtacacttttgaaaatcgctgtgttgaggatacttctttatcacttggcgatgccacacaaaagatttttctgaataccaaaggcatctttgatgatgtccgcccggaattaaaacgactgctcaatttcattgacggcaaacagccggaagatgcgttcacacaggaactttcagaagctgttgaagccgccaaacgcaatgagaaatggaggcttgattacatgaccttacaaatggcttatgacgaaaaatatcaggaaggcttagaagccggtatgacagagtctgcaaaacgtatgctttccgccggtaaatatgcagatactgaaatctctgaaattacgggactttctttggaacagattcagcaattgaaagaatcttccatcaaagcaccatcgtctgtctcataagataaaatgtcacatccgcctccggatcggtaagctctatattgatcctgtccggatgccccgtcatgttcaatggtgtagatacatgaaattgatctgccactttcgataatgttccaagttctgcaaaggcaacaagctgacgcagctcatataaatccagcattgcgctcctccttttacgtttcattttttgaaatgcagtttacgatatctatcgtgtacttctgcacaaatctgttgtaaagtcataatcagaaagcaatcttacatttcaaaaaatatcacacttcgtaaaataagaaaaaacaaggaggaacgaaacatggaatatgttaccttaaacaacggaatcaaaatgccaaaactcgtatatggtgtttaccagatttatcccgcaaccgtccggatctgatcctgctggatttgatgcttccgggactcagcggggaaaaagtgctcgcgcacgctgtcaaaattcccgtaattgtcgtaagcgcaaaggaggattacaacaatttattattacagcacttctgctgggctttgtattcatccatggggtttcctatgatcccggatttttgctgacacacacacttttggaggtttgtatcacccttgccttttccgctgtgcttgtatgtctttccatgtgcatcccaaacaaagccgtcagtgccgttaccggactcctgctgaccataatcctgctgggttctgcgctgaccatctccatgcgtctatccgcgcccgaatatacagaagccttcgcatatactgatgaagcctcaggcaaactcattaaggttgaccgggaacgaaatgaccaatatctgaccggcacaaaacgcaaaatctatacttttttgtatgattttctcccaacctgccagttttatcagattgttcaggtatccgatacaccgattgaaaactatggtatactcattgcatatgacggactgctgctgtttctgagcaccggggccggcatccttattttcgggaaaaaagatttaaaataggagaattttatggaattgtggctagaaagttgtatcgtggtattggcggttcttgtccttttattatgtatgcgattacatctggcaaagaaggtggcactggaaatccatgccgcccttccggagaaattaaataccgacaccaatacaccgattacactttcctgccgggataaagatttgtgttttctggcggatacgctcaaccagtccctggaacagctccgtgccatgcagcattgttttaaacagggaaatgcccagttacagacttccatcaccagcattttccacgatctgcgcacaccgctgactgccatctgcggcaacctggaacttttggaaaaggaaccgttatctactgtctctcgccagtatgttgccatcatccgggaacgcacaaaggtgatgacacaactgacggaagaactgttccggtattcggttgtcctgtctgtgcctttggcacagcccctgcaggaagtgtcggtaaagcgcattttagagggaagcattgccgcaatgtatgcggtgctcaaaagacaccggatcacgccggacattaccataaccgaccataccgtgctgcgcacgctcgatccgtccgccttatcgcgcgtcttttccaacctgttaaacaatgccgtaaaatacagtgacggggatctttccatcacgctttccgaagacggcatcatcaccttttccaatacagcggcagcactcagtgaagtggaagtcggcaggctttttgaccgcttctataccgtggaaaatgccaaaaatgcgaccggtcttgggctttcattgcacggacactggtggagcagatgcacgggcagatggatgcctcttatgaagcgaggaggcttgtcatctgaaggcagatttagtttatttttttataaaacagaccaaaaataaagcaactacaacaactcctgtgcctatgattatacacctctttgctgtggtgacttctttttgatataagcgaaataattctccggaatgattctttctattatggagaccaatcattgcatagatcaaaaagaatgcaactccgaatattaaaattacactcagtcgtccccaggcagaaggaatggtgtattgaccgattatgatacatagcaggatcataaaatacacgattttattttgcccatatcctaaaggaagttctttttgataatttctatacatcatttttccataataaacgatcatgcatattaaaaacaatagatagattatcatgaccattgatcccattcataatcattaccatataaatttgggacaatgtattgcataagtaaggatgtagcgttcttattattggaatcataataaccaccaccctcatagtataccttattaattttgtcgctttcctcatcggtaattatatacttacatgtcttgctatatgtagtagattttttacctgttttgctgtcttttccataatattttaagttatatttgtcagcagctaaggttatttttgtaccaatattaagtatatcaccgctaacaacaccaagcccagcagaaattatagcagctactattctacttgctattgaagaaggaacagccataccagtggcaataccaactgctaatgcggcaacagttccactaaatgttctgatagaatatgttgtgtgaacagctgaaccgatattctcatataaatacatactatgtctatctaaatttactctattatagacaggaaatgtaccaattctgttaaatgaataagttgacggcaaaatatcggttgatatagtctcaataatatcattcacattaaatctatcgttaacaaaagcatctgatgcaataatttctccgttgcttctgtttgctgtagcggacgcaatcaaattatcttgtgaattatattgctctgcgtatacgatatttccagaatcccataaaactaatttgtaatccccaatataggaaatacttttaccctgttcattttgtatataggtggaacttgtattctgtgcaaatacagttgcagatgtagaaaaagtaagacaaatgattaataatacagaaattattcgtttattcataaagaatcctccctttaatatccatctcttttatataagaatagctacataatttaaaaaatatataattttgaagagtacattggaatcaccttatcctttcaaatcatcctataaaatatagtgttttcataaaaattatataataaaattactatattttcaatattttccgtaaaaatattgaaaataaaaacgagataattatgaaaaaatcataattaataagattagcggtcaatgtgagtgggagtacggtgtataggttgacaccaaaaaggcactcccttatacttgagaaaaacggtgcaaaaaactattaataaggtttccaaagtttctgggagcatctttgatttaagacggatatagaaggggcatctgctgacatttgaaaaaatccaggaattcacgcttggtaaaggattcaccttaagaactaagggacaaaataatctgctccggagagagttctcggacacgcaaaaaatctttttccggatgagaaacaaaagaatctctatcagataaaagattttaatttctaatccgtggatcgctctcgtcacctcataataaagtcataatcagaaagcaatcttacatttcaaaaaatgtcacacttcgtaaataggaaaaagcaaggaggaacgaaacatggaatatgttaccttaaacaacggaatcaaaatgccaaaactcggatatggtgtttaccagacaccgccggaagacacgaagcactgcgtgctcgatgccattgaaatcggctaccgaagcatcgacactgcacaggcgtattacaatgaagaaggtgtagtgccacactcgcttcctgcggtctgccgcgtgaagaatttttcctgacaaccaaagtatggatcaccaatgccggctatgaaaaagcaaaggcatccattctggaatccatggaaaaattacagaccagctatctggatctgctgctcattcaccagccgtttggcgattattacggcacttaccgcgcgatgaaagaactgtataaggccggaaaactgcgcgccatcggtgtatccaatttcggtccggaccgttatttggacatccagcactttgcaaccgtaaagcctgcggtaaaccagatcgaaacccatgtcttccagcagcagaaagttgccagagaatatttacagaaatacaactgccagccggaatcctgaggaccgtttgccgagggacgaaacgatatttttaccaaccctgtccttacaaaaataggtgaaaaatatggaaaaactgccgcacacttttgcacccgggcggatgtgttgcataatctttcgctccgcggggtgcgcatctttgcaggcttactttttctatttctcattcccttatctatcagcgctcctgaatttcttttccgctgagatgctcgatcgtaatttcgtaaacctgtacggctcttccagactgggcaatttctccttctatcagaacatcatccgggtaatacttttttgcaatctgtctcaccagatctattgtccggtttctgtcttcgagaatccggcatcttccgaatactaccacactctgtaaaaacggagtccacggttcttctttgaccatttcattcccgtaaacggtaaaacataccctgtcatcttttttcagtgcatctgccttatgtccgaccgccgcgccgtgaaaataaattttaccttcctcttcgctgtaataaaaattcaccggaacggcatatggacaaaaaatataaaaattttcaatccggcataataatccggatcagatgtttatccagcatgattgtccggttccagggattgataataatccctgcgatctccggcacagtaagtgctgcttcaaacatcctgccgatctctgacaaaaatgtcgacttcacctgatctgcaccttttaattcttcctcaaagctggtaaatgccgaccaccagattttaccgtccggagtcctcactgtctgtaacttcatttgtgcctgtgccggatccggttccacagcaacgatcagttgtcctccctctttcatccgccgccggatcaccgtcaacgtatgtgcaagctgctcctgtgtggcttctttctgaagcgcaaaaattgcatcttctattctttcattgccctttaatccctcatcctgatattcatttttcttattcatatttcatatcctctcttgtctgctcctttctattataaaatgagaggtttctttttgaaagctatttctttcagattctccttttgggagaattcttttgacggaaccgtccttctctttctctgagactgcgaatctccaactctccaactcatagattgtattctctgcacgtttcttctatactgaaagcagacagacactgcagcaactgtctcttacgaaatggaggttccactatgtcacaaaataatattggcgaatttatacaacaatccagaaaagccaaaggatttacacagaaagatctcggtgaccggatcggcgtcagtgataaaaccatatccaaatgggaaaacggaaacagcattcctgacacttcgattctgaacgaactttgtgctactctcgatatcaatgtcaatgaacttctctccggtgaaaaattaacaccggaaatttattctatgaaagcggaggaaaatatgataaaccttttggaagacaatcaaaaacaacagtgctttacactccttccctgtgcagtgggtatcgttttactgatccttaccggactgtttgcaatatttacgcatgtgcttttaccggatatgctggatcttttggattttccaacactcctcatttacatcggaatctgttgttcccttgttttattgagcggaaagcgccataaacaggaaatcattcactttctccggaaaattgtggtacctgtcggatgtatctgtcctctgttggggataaaccagtttattcatcagttccgtgatccggctgatattggttctttcgtaaaccaatgtgtcttatttgttctctattccctgatttcctatgtgattctggttcttatcgaacagcatctggacaaataaaattttatatgtaaaaacagcccctgtacctattggtaagggactgtttttattttatcttacatattcttaaccgttgcaatatccactggagtaagctccccgtgagcggtctctaaagaacgtgccagcgcatttgcggtatccatagcggtgatacagtacacaccggtctcaatcgcattacggcggattaagaatccgtctcttgtcttatcaccgttaccctgtgtcggtgtatcgatgacaaggtcgatcttgtggccaaggatcagatccattacatttggtgactcctgcgaaatcttattgacacgcagtgcattgacaccgtgctcctgcagatactttgcagtgcttcgtgttgcgtagattttgtagccgagtgcctcaaaacgctttgccacaccgactgcctccggcttatcggcatcctttaccgtcataatcatctgcttgtatttcggaagctgtacacctgctccaaggaatgctttgtacagtgcctcattgaatgtctttgcgatacccagacactcaccggtagacttcatctccggtccaaggctgatctctgctccacgcagtttctcgaaggagaataccggcatcttgattgcgatataatcggcaactggtgcaagtcccggctcatagcccagaccgcggatcgtgttaccgatgatcactttggttgccagatctacaatcggaataccggtaaccttactgatgtacggcacggttcttgaggaacgcggatttacctcgatgacatatacttcctcattcatggcgatgaactggatattgatcagaccgaccacatgcagtgcctgtgccagacgctttgtatactctacgatggtatcctttaccttatcactgatcgttggagccggatatacggaaatactgtctccggaatggactccggtacgctcgatatgttccataataccaggaatgagaatgtcggttccgtcacatacggcatcgacctcgatctccttaccctgtaaatacttatctacgaggattgggtgatcctgtgcaatacggttgatgattccgatgaactcctcgatttcctcatcgttaaacgcaatcttcattccctgtccgccaagtacataggaaggacggacaagaaccggataaccaagacggtttgcaacttctttggcttcctctgcggtgaatacggttccaccggctgctctcggaatatgagtcttctccagaatctcatcaaaaagctcacgatcctctgcggcatcgacatcctctgccttggttccaagaatcggaacgcccatcttcataagcgcctctgtcagtttgatcgctgtctgtccaccgaactgtaccacagctccgtccggtttctcaatatttacgatggactcgacatcttctgcggtcaacggctcaaaatacagcttgtctgcaatatcaaagtcggtggaaacggtctccgggttgttgttgataatgacagtctcccagccttcctttgcaaatgcccaggtacagtgtacggaacagaaatcaaactcgataccctgaccgatacggatcggaccggaaccaagaaccagaacctttttctgcggtgtggtctctgccgcctcgttctcacttccgtaaacactgtagtaatacggtgtctctgcagcaaactctgcggcacaggtatccaccatcttatatgctgcaacgataccgtttgcataacgcatctgtttaatctcttcctcggtctttccggtaagctctgcgataacgttgtccgggaactcgattctctttgcttcttttaacagatctaccgtcagttcttcgctctttaagtgctgctccatctctaccagaattgccagcttgtcgataaaccagcggtcgatcttggtaatttcataaatatgatcataggaaacgccgcggcgcagtgcctctgcaatcacccagattctacggtcatcgaccacatgaagctgtgcctctaactcttcatcggacagtccggtaaaatcataggacataaggctgtccacatgctgttccagggaacggatggctttcatcagtgcgccctcgaagttatcacagatactcataacctctccggttgctttcatctgtgtacttaacgttctctttgcagtaaggaatttatcaaacggaagtctcggtatcttcactacacagtagtcaagcattggctcgaaacttgcataggtcttctgtgtgatggcgttcttgatctcatcaagtgtgtagcctaatgcaatctttgcggtaacctttgcgatcgggtatccggttgccttggaggcaagagcggaagaacgggatacacgagggtttacctcgatgacacagtactcaaaagaatccggattcaatgcatactgcacgttacatccaccggtgatctttaactcattgataatatttaatgcagaactacgaagcatctggtactctttatctccgagcgtctgggaaggtgccactacgatggaatctccggtatgcacaccaaccggatcgatgttttccatgttacatacggtgatgcagtttccgttcgcatcacgcattacttcgtactcgacttccttccatcctgcgatacagcgctcaaccagtacctcaccgacacggcttaaacggagtccgttgcttaagatatcgaccagctcctgctcattgtgggcgataccgccgccacttccgccgagggtgaatgccggacggagcacaaccggatatccgatcgtattagtaaacttgataccgtcttctacggtatttacaacctgggaagctgcacaaggctcaccaatcttttccatggtatccttaaatgcctgacggtcctctgccttaaagatggtttctgcggtcgtaccaatcagttttactccgtgctcttctaagaatccggactctgccagttccatacccagatttaatccagcctgtccaccgagtgtcggaaggatgctgtccggtttttcctttaaaataattttttcaagaaccggaagtgtcagaggctcaatgtatacctgatctgcaatctgcttgtcggtcatgatggtggcagggttggagtttaccagacatacctccacgccttcttcctttaaggaacggcatgcctgtgttcctgcgtagtcaaactcggctgcctgtccgatgacgattggtcccgaaccgattactaatacttttttgatatctttatttcttggcattactgattccctcccatcatctgaataaagcggtcaaacaggtacgaagagtcctgtggtcccgggcatgcttccggatggaactgcacggtgaaaatattctttccgacatactctaagccctcgttggttccgtcattgacattgacgaatgcaggctttgcaaccttcggatcaagggtatcggtatctaccacatagccatggttctgggaagaaatgtaaacacgaccggttgacaaatctttcaccggatggtttccaccacggtgtccgtatttcatcttgtgtgtatccgctccgttggccagtgccatgagctgatgaccgagacagatggcaaagatcggtacgtcacttgcatacagtttctttaattcctcgatgatcgctgtgcactctttcggatctccaggtccgttgctgagcataatgccatccggattggctccaaggatttcttccgccgatgtgtgtgccggataaaccgtcacctcacagccacgggcatttaacgattttgcgatattgttcttcgcaccgaaatccatcagtgcaactttctttccgcttccctttaatacgttcttctcgctgcaggtaactttatccacaacgtttccagttgtatattctttcaatttcggaaggatttcatccagattatagttttcatttgtggtgatcattccgttcatggttcccttttcgcggagaatcttggtaagcgcacgggtatcaattcctgcaattcccggaatatcatgctttgtcaggaaatcctgaatgcttccctgacagcggaaattgctcggcatacgtgaaagctctcttacaatatatccgtccggccacggtctggcggattccatatccggtgtaattccgtagttaccgatcagcggatacgtcatcacaaccgcctgtcctgcataggacggatctgtaagtacctctaaatatccggtcattgaggtattaaatacgatctcactgatgatttcgcgtgtagaaccaatgcttgtacctgtaaacacggttccgtcttccagtatcaaaaaagctttcattctttgccctgcctttcttgcatcttggcaaaaaaaaagagagaatctcttttttttaccttgagttagctttacctaaattgtaaaaattttatcacaaatcgtcacttttttcaaccttttttgcaagagaaaaaagtgacatattttatgaataaatatacatattatacaattccatgcatccacaataccatgaacccgacagcaactgccgcacagactgccagaccgccaatgctggttccgaggatcacgccggatggaatttctttcttttcatatatcgcgcgtgccacggtttttgcctgcatcggaacaaatgaacacggctgtgttacctccattggatgaaaccggcgtttggtaaaataatccgctgtccatgccggcattgccgataacgtcaccctctgtaactgatattgatttgccgcatacgccttcatttcttccaacagacatctgccacatcctctgcgctggaataccggaagcacatacagcatggtaatatgtccctctttctgcattcctgacatggcgatcatatgtccctgttcaaaaattccccacatggtgagagttccttctgcaatcatgttccggatgtttgtgttttccgtatattgcagaaatatatgaatcatttccagatccgtgatccgcgcacgcagacagtaatcaaagacaccccttgcaatactgagcgcttccggaatctgatcttccgttaaaatctgtgctttcatttacgcttcctccttattttccaacagccggtccttcagaccgctgtaacgtctctgttgggaattattctcaatcatttgttcaaatgttgtatcatctcctactatcgtaacacatttctttgctcttgtaaccgctgtgtacaataaattccggttcataagcatgcggggtccggaaagaagcggaatgacaacggccggatactccgatccctgtgatttatggatcgtcacagcatacgcaagttccagctcatccagcagtttgtacgaatattccaccatacgcccttcatcaaaatttaccgtgatggtctctgcaaaatcattgatctcttcaataattccggtatctccgttaaacaccccggttcctttgtctatgcagagtccatatttgctgcggatctcccattccagctgataattatttttgatctgcatgactttatcgccttcccggaaaacgatcgccccatgctctttctccttttttctgtccgatggcggattcagatacatctgcagaatcgtattgagacgttctactccgagcagccctttccgcataggcgtaagcacctggatatcgtattcgcttgcccccacaaatttcggaagtttctgcttgatcagctgcagcgtaacgttgataattttatctgcctcataacgcttcaggaaaaagaaatccatgctcttgttatccaggctgactttttctccccggttaatcttatgcgcattgacaataatatcactggtgcttgcctgtcggaaaatttttgtcagcattaccgtaggaaacatcttcgaatcaataatgtccttcagcacacttcccgcccctacactcggcagctgattcacatctcccaccaggatcagacgcgtgcccggcaaaattgctttcagcagggaattcatcagggaaatatccaccatcgacatctcatcaataatgatgagattggtctccagcggattttgttcattgcgctcaaatccggcatttccttccattccgccattcagttcgagcatccggtgaatcgtccgtgcctcatacccggtggtttcgctcatgcgctttgctgcccgtccggtcggtgccgccagcataatatcttctccggataattcaaaataccggatgatcgtattgatcgtcgttgtttttcccgttccgggacctccggtaatcacgagaacaccgtttcttacggcttcctttaccgcttctacctgatgctcatcaagatccattcccgtcttcttttcaatctttcggattctgtcctcaatttcgatatccggaacatcaaacacagcattcagctgtgtcagacgggtagcggtatttgcctccatataaaaataggttgccgcatagatctgcgtactgtcttccacctggcgcataatgatcttgcgatccatcgccaaattcatgtaatgctgctcgatgtgctccgggtctacctcaagaagccggcttgcccgctgcgtcagttcctgcatcggcagataggtatgcccctctccggcagcctgcagcagcacatactggataccgcttcgaatccggaaatcggaatcggtgcggattcccacacgggatgctatctcatctgccgtgcggaatccgaccccttccacatcatctgccatacgatatggattttctttcagtattccgtatatttcctgcccgtatgttttatatattttcaccgcaagtgtggtattgatcccgtattgctgcaaaaaaatcattgcctgccggagatcttttttctgattcacctgatccgcgatttccatcgcctttctctggctgatgcctttgatctccgccagccgctccggttcttcttcaatgatacggaaggtatctgccttgaatcttcgcacaatccttgccgctaaggcaattccgatccctttgatcgcccctgatcccagataccgctcaattgccacctcatcctgtggtgccttttcttcgaaactctttacctgaaactgtctgccgtaagtcggatgttctgtataacttccctttgccttaatgttttctccctcggcaatatccgaaaatactcccacacaagtctcttcttcttcgttacacaccagaacaagtacggtatatccgttgtctgcatttcgatagatgatgtgatctacatatccttcaatgctctcaagattctcttccaaaatatgttccccattctctaaaaaagagactgttgtaaacagtctctcctcttttctttgtgctgatgttactactggccaatattacgtttcatctgctcatacagtgtctgtgtatagctttctccgatctgatccaccatttcatctgccaccgtttcaattgcctgatccatatacagatctttgtactgtgacatcgtagaatccccgtcatcatccgaggtaaatgtatctttcatctgtttgatgacctgctccacaaaataagattcaaaatctttgatgacaccttttaattgttcctctgaagagtccgatgaaatattctttaatgaactctgaagagaattgctctgctctgcacttttgtttgcatttgcaaccgtataatttgtactgattgatgaaatatccatagtatatccctcttatgtaagtaattccgaatcgctgcctatcgtttcaggttatttgccgtctccagcatggaatccgaggtcgtgattgccttggaatttaattcatatgcacgctgtgcaatgatcatatttaccatctcatcagcaacctgtacatttgaagcttcgatgtagccctgatatacaccggtcttcgtcaatcctgcattttgtccctccagcatcggatttcccgaagctgcagtcgctgcaagtttgcttcctgacattttctccagtcctgccggattgttaaactgatagattccaaaagactggtttaatgacactacattgccggttgcatctttatagccaatcgttccattgctcgaaaataccatgctttccgaagatacgcctctcggcacacgaatggtatttcctctggaatccaataccggaagcccctctgaggttgccagaattgtgtttccattcgaatcctgactccaggagaagttaccgtttctggtgtaatatgtctgtccatccacaccccgcacggcaaagaatccctttccttccagtgcaaaatcggtcggaatctctgtctcttcacgcgccccctgcgtatagttggacatggtcgctgccactctggttccgagtcctacctgtgcacctaccggtttattggcaccatttgccgtcgttgtctttgtctgcagtgtctggtacagtaaagatttaaactcggtacgttccgtcttataacctgtcgtattcacattggacaggttatttgaaattgtatccagatttgtctgctgcgcaatcattccggttgccgcagtataaagtgatctcatcatacgcttctatttcctccttgcggtctttcagcagctattacactttaccgacattgttaactgcccggtcaagtgttccatctatggaagtgattaccttctgtcctgcctcataggctctctgaattgtaatcatatttaccatctcatttacaacatttacattggaagtctccagtgtgccctgctctatattggcatctgttgcaatccggtttcctcccggaagaaggttatacagattctcaccgtatttttcaagatagtcataattatccacatccaccatgccgatcgttccgacaatctggttattctgcatgacgtatcccagtttattcacggtaatcgcagcatttggatccagacgtatataattattctgacccggatcgccattcattgcaccagtggcatttaaaacataatcgccatccttcgtcaccagatacccctctttatttacagtaaaggctccatcccgcgtatacttcacggaagtatttccctgcttgtccgtgaatgccacggcaaaaaagccatttccttcaatcgcaaaatctgtggtgttatctgtcaccttgaaatttcccgtggaataatccgtatatacctgtccaaggtgaaccccatatgtaatatctccaagctttttcggaatccccatgttagaagaatccttaatgcgcaaagacatctcatcggcaaaagtgcgactcgtcgttccttcttttttatatgctgttgtgtctgcgtttgccagattatttgccagaatatccagacgcttcatttcgtttaccattcccgtatgggcggtatacaatccttttaccatttatgacacctcaattttcacagttttaatttatatcggcaaatgccctcacgagctttatagacatgcgataaaaagtgcgcataaacgcgcactttatgcattaatcctcgtctctttttcctgcaaggaattctacatattttccggttccgattgctacacaggtcataggatgctctgccgtcatcgtgttgattccggtacgttcttcaatcagttcctccagaccgcgaagcaaggagccgccacctgtcaggacaattcccctgtctgcaacgtctgctgccagttccggtggagttttctccagtacggaatgtacagcttccacaatctgtaatgttgcctcacgcagagcttcctctgtctcctcagagcttaccgtaatggttcttggcagaccggttaccagattacggccacggacatccatcgtctcattctgtgccagtgggtagcatgtaccaattttgatcttgatatcttctgcggtacgctcaccgatcaaaagattatgtttctttctcatatagcggaccagggcttcgtcaaaatcatctcctgcaattttcacggaagtgctcacaacagaaccacccagagaaatgactgcgatatccgaagtacctcctccgatatctacgatcatgtttccgcatggtctggaaatatcaataccggcaccgattgctgctgcaattggttcctcaataatctctacttcgcgggctcctgcctgataagttgcatcctctacggctttcttttcaacctctgtaacaccactcggtacgcagacgctgatgcgcggcttacgaaagctcttctttccaagtgccttctggatgaaatacttgatcatcttctctgtgacggtataatctgaaatcacaccctggcgaagaggacggactgccacaatgtttcccggtgttcttccaagcatcagccttgcttcctcaccgattgctttaattttattggtatctctgtcaaatgcaacaacggaaggctcttttaatacaacaccttttcctttaatatatactaaaatactcgcagtacctaaatcaattccgatatctgatccgatcatcccgaatgccccttcctattttctttttatctttctttatcaaaatccgatctgcgtttatggcgcaaatctgcagttaatcatatttttatgcatacagtaacattatatacaattcatcccatttttcaaacatttttttataggttaaagcattttaattaaattttaaggaatctctctgttcccaggacaaaaatctgtgcattttcgctattttatacgttcttcgattccagatacggttttaaaaactgaccggtatacgattccggaactttgcagatttcctccggagtcccctgtgcaatcacggttccaccaccgtcaccaccttccggtcccatatcaatgatatagtcagccgtcttgatgacgtccagattatgctcgatgacgacaacggtatttccgccgtccgaaagctttctgagaatctccaccagcttgtgtacatccgcaaaatgcagtccggtggttggctcatccagtacataaatggtttttcccgttcctcgtttgctcagttctgtggcaagtttgatacgctgcgcttctcctccggataattctgtggaaggctgtcccagttttacataggaaagtccgacatcgtacagtgtctgaatctttcggtggatcgttggtacatttttgaaaaattccaatgcctcttccaccgtcatatccagcacgtcatagatcgtctttcctttatagcgcacttcaagtgtctcgcggttatagcgcctgccaccgcagacttcacacggcacatacacatccggcaggaaatgcatctcgatctttatgataccatctccgctgcaggcctcacagcgtccgcctttgacgttgaaactgaaacgtcccttcttatatccacgtgcctttgcatccggagttgccgcaaacagatcacggatcatgtcaaacacaccggtataggttgccggattcgaacgcggtgtgcgtccgatcggtgactgatcaatatcgataatcttatccagttgttccacacccagaatatcatcgtgatctccggggatgcagcgtgcccggtttaaagttcgcgccagatgcttatacagaatttcattggtcagggaactctttcccgatcccgatactccggtgatacaggtcatgataccaagcggaacctgcacatcaatatttttcagattattttcccgcgctcctttgatggtaagaaatccggtcggtctgcgccgttccgatggtaccggaatcttcatccggccgctcagataagcgccggtaatggattttttgcatttcatgatatccgccgcagtaccggtcgcaacgacttctccaccatggacaccggctgccggaccaatatccacaatgtagtcggccgcacgcatggtatcctcatcatgttccacgacaatcagcgtatttcccagattcttaagattcatcagtgcatgcagcagcttgtcattgtcccgctgatgcagtccgatactcggctcatccagaatatatgccacgccgaccagtcctgaaccgatctgggtagccaggcggatgcgctgcgcctctcctccggacaaggttccggtcgcacgtgtcaatgtcagataatccagacctacctcctgcaaaaagcccacacgggcacggatttcctttaaaatctgattgccgatgaactgctgctgttccgtcagctgcatttccgccagatatttcacgagatcctttaccgacatatcggtcatctcatatatatttttgtctgcaaccgtaaccgcaagagaactctgcttcagacgctgtccatggcaggcagcacacggtgtaatacgcataaactgctcatattcctgcttcatcgtgtccgatcccgtctcccggtaacggcgctcgacatttttaataaggccttcccagttcagatcatagacgccttctccacgctgtcctttataatgcacctttaatatccggccatctccgccatgaatgagcatatgccggatttcttttggcagatctttatatggtgtatcgagagaaaatccatatccttccgacaacgcttttagggtagcataggtatagctggacggatcggtgcaggactgccagcccattacctgaattgccccctcggaaatagacagtgtcttatccggaatcatgagattttcatcaaactccatcttgtaaccgagtccgtagcagaccggacaggcaccaaacggattattaaacgaaaagcttcgcggttccacctcatccacactgattccgcaatccgggcacgcaaaattctgggaaaaattcattggttccccgtccaccacatctacaatcgcatttccctcggtcagctcaaaaacattttccagggaatcggtcagacgcttttcaattccgggttttaccaccagacggtctaccacaatatcaatattgtgtttgatgtttttatccatcggaatttcttccgaaagttcatacatatttccgtccacgatcacacgcacataaccgcttttttttgctttctcgaataatttctgatgttcgcccttacgcccgcgcacaaccggcgcaaggatctggatgcgtgtgcgttccggcagtttcatcacggcatctaccatctgatcgatcgtctgtttctcgatggcacgtccacacttcggacaatgtggaattcctatgcgggcatacagcagtcgaaaataatcataaatttccgtcacggttccgacggtggaacgcgggtttcggttcgtcgatttctggtcaatggagattgccggcggaagtccctcaattgactctacatccggtttttccatctgtcctaagaactgtctcgcataggaagacaaagactccatatagcgccgctgtccctccgcatagatcgtatcgaacgcaagcgaagacttgccggaacctgacagtccggtcagaacaacaaactcatctctcggaatgtccacatcgatgcattttaagttgtgttcgttggcgcctcgtattttaatatattttctctgttttttcggcattttgtttcctctcttttatctattcctcaatatcccgaagcatatttttcagttttaccatcttgtcacgatactctgccgccgcctcaaaattgagttctgcggcagctttcttcatcttcttctggatgtccccgatcagtttttctaattccctgcggctcatggattccggatctttatcaaattccatctcctctgctgccacttttttggagattgcaatcagatcacgcacagatttctggatggtcttcggtgtgattccatgttcctcattgtatgcctgctgaagcttgcggcggcgctccgtctcatcaatggccacacgcatggaatccgtgatcttatccgcatacatgattacatgtccctcactgtttcttgccgcacgtccgatggtctggatcagtgaagtctcggaacgaaggaatccttccttatccgcatccagaatcgccacaagcgtaatctccggaatatccaatccctcccgcagcaggttgataccgacaagtacatcaaacacgtccagacgcaggtcacggataatctctgcacgctctaaggtatcaatatccgagtgcagatattttacacggatgccaagttcgctcatatactgtgtcagatcctccgccatacgcttggtcagtgtcgtgatcagcactttatggtgatttttcgtctctttgttaacttccccgatcagatcatcgatctgcccctcaaccggtcgcacggaaatctccgggtccagaagtccggtcggacggataatctgctccacacgcagcaattcatgctcgttctcatagacattcggcgtagctgatacaaacagcatctgatcaatcttgctctcaaactcttcaaaattaagcgggcggttatcgagtgcggacggcagacggaatccatagtccaccagtgtctgtttccgtgagcgatcccctgcatacattccacgcacctgcggaatcgtaatgtgggactcatccacaataatcagaaagtcgtccggaaaataatccatcagtgtctccggcatttctccctcggcacgtcctgccagatgacgggaatagttttcgatgccactacaaaatccggtttccttcatcatttcaatatcaaaattcgtgcgctccgcgatacgctgcgcttccagcagcttatcctcccccttaaaatacctgaccctctcttccagttctgcctcgatacggtcacacgctgcgttcattttttcctgtggcaccacataatgggacgccggaaacacagccgcatgctttaatatacatttgatctctccggtaagcacatccacctccgtaatccggtcgatctcatctccgaaaaactccactcggatcgccgtgtcggtattattcgccggaaaaatctccagtacatcgccatgcacacgaaacgtaccacgcttaaaatccatctcgttgcgcgtgtactgcatgtcaatgagtcccttgatcacatcatcacggtcaatctccattccgggacgcagggaaaccatcatgttcatatagtcatccggactaccaatgccatagatacaggagacagatgccacgatgatgacatcttttcgctccgccagtgctgccgtggcagaaaggcgcagcttatcaatttcatcattgaccgcagaatctttcgcaatataagtgtccgactgtggcacatacgcttccggctgataataatcatagtatgagacaaaatactcgacggcattctccgggaaaaattctttcatttctccgtacagctgccccgccagtgtcttgttgtgggaaataatcagcgttggcttattcagcgcctgaatgacatttgccatcgtaaaggtctttcccgaaccggtcacacccagcagcgtttcaaactggttgccttctttgaatcctttgactaatttttcaattgccttcggctggtcaccggttggctcatatggggcatgtaatttgaactccataatgccctctcccttctcaaatttattgtaaaattaactttattccatgaaaaaaagataaaatccatatctttatagtctgcacatatatgctaattttactacaaagatctgactttgtctatcttaatcagaacatttgttctcatctttctttttgcctgtaaagtgtgtatgataacagcaaatacatgtcacaaaagataaggagattttgtatgaaaagaagaaaagaatttcatttatttccccttggaatattgttatttgccctgacattaaccatagtttcaggccggattgctatccatgcggcagatctgaatacagaactgcccgcaaatgactccacggaaatttcttccgaaattccaacggaaacaccggtggttccttccacggaaaatcccaaaccggtattgcagggacttatccatgataaaaacggacatttctatttttatcagaatggaaaaaagctgaaaaaccggtggaaaaaggttggcaaaaacaaatactatttcgggaaaaacggacaggcagttaccgggaaaaagaatatttcccattacttatgttactttaataaaaaaggggttctgacacggaaaatcgataaaaacaaaaagatggttgccctcacttacgatgacggaccatcggtttataccccaactattttaaaaaccctgaagaaaaatgattccgttgccacattttttgtggtgggcagccgcgtatcgacttactccaaaaccgtacagaaggcttatgacaacgggtgtcagattggcaatcacacttatgatcacaaaattctgacccgggttggaaaaaaggaagttcaaaaacaggtttccaaaaccaatcgtgccgtcaaaaaagtaatcggtataaatccggttgtgatgcgcccaccgggaggtgccaccagttccaacatcaaatcatgggtgggaatgccttccatcatctggtccatcgataccttagattggaaaacgcgggattccgcaagtacccagaaagccgtattgaaccatgtaaaggatggagatatcgtactgatgcacgatctgtataaagcgaccgccactgcctcccagacaatcattccggaacttaccagacgcggatatcagctcgtcactgtcagcgaacttgcagagtgccggggcggcatgaaacagaacaaatcttattctaaatttccaaagaaacaaaaatagtgtcattacaaaaaaacgcggaaaccatgatggtttccacgtttttgttatctgcttcgattttatacaaccttacgtccgcagcactgcttatatttcttaccactgccacatggacacggatcattcggatataccttggcatgttcacgcttcttcggtgcttttgccgcactctcgtccttattggttccggttacttttgcgacctgctcacgctctaccttctgctctacctgtacatgatagagaagacgaatggtatcctcctgaatacccgcgatcatttcatcgaacatatcaaatccagccatcttatactcaaccagcggatctctctgtccgtatgcctgtaatccgataccctgacggagctgatccatatcgtcgatatgatccatccacttgcggtcgatcaccttcagcaatacgacacgctccagctcacggaactgctcgatctccgggaattcggtctctttagcttcatataaaagcactgcctgttctttcagatgctgctttaattctttgacatccttgatatcttcgatatttttctctgtaacaggttcaagaggaatcaccggcagaagaatttcatttaattcatttaaattccactcttcgcgcggaatctcattcgaaatacaggtatcgactgatttctccacctgttcctgaatcatcttaaaaatcgcatcacgcatgctgtctccatttaatacggacatacgctctttgtaaatgatctctctctgatcgttgtttacctgatcatactctaacagattcttacgaataccatagttgttgtactcgatcttttcctgtgccttctcgatggcagaagtaagcatcttgtgctgaatctgctcaccttccggaacaccaagtgcgttaaatactgacatcagacgctcggaaccgaacagtctcatcagatcatcttccagagaaataaagaactgggattcacccggatctccctgacgtccggcacgaccacgcagctgattatcgatacggcgggattcatgacgctcggtaccgatgatctttaaacctccggcttcacgtgcatcctcgtccagcttgatatcggtaccacgtccagccatgttcgtagcaatagtaaccgctccgtgctgtcctgcctgtgcaacgatctcggcctcctgctcatggaattttgcattcaatacggtatgcggaattccctcacgctttaacattccgctgatcagctcggaagtctcaatcgtgatggtaccaaccagaaccggctgtcccttctcatgtgcttccttgacttcctcaacaactgctttgaatttttctttcttcgtcttatataccgcatcctgatgatcgatacgtgcaatcggacggttggtaggaatctcaataacgtccatgccgtaaatatcacggaactctttttcctccgtcagagccgtaccggtcataccggctttcttctcaaatttattgaagaagttctggaatgtaatggttgcaagtgtcttgctctctctcttaacctttacatgctcctttgcctcgattgcctgatgcagaccatcggaataacggcggcccggcatgatacgtccggtaaactcgtcaacgatcataacctgatcatcttttaccacgtaatcctgatcgcggaacatcagataatgtgcacggagcgcaaggatcacattatgctggatctccaggttctccggatctgccaggttatcaatatggaaaaatttctcaaccttttccacaccctgctgtgtcagattcaccagtttgtccttttcatttacgataaagtctccggtttcttcctgctcaattcccatgatggcatccatcttggaatactccggtacatcctcaccacgtgtcagctgctgcgctaaaatatcacatgcttcatataatttggtggacttgccactctgaccggaaataataagaggtgtacgcgcctcatcgatcaatacggaatcgacctcatcgatgatcgcatagtgcagacctctctgtaccagctgctccttgtagatcaccatgttgtcacgcaggtaatcaaatccaagttcgttatttgtaatatatgtaatatcgcaattgtaagcgtcgcggcgctcatcgttgctcatatcattcaatacaacaccaacggtcagtccgaggaattcatgcacttttcccatccactcggaatctcgttttgccagataatcattgaccgtgacgatatatacccctttgccctccagcgcattcagataagccggaagtgtagataccagtgtcttaccttcacctgtcttcatctctgcaatacgtccctgatgcaggataataccaccgataatctgtactctgtaatgctccatgccaagcacacggcttgctgcctcacgtacggtcgcatacgcttccggaagcagatcgtcaagtgtctctcctttttccagacgctccttatattcttttgtctttccccgtaattcttcatccgaaagtgccttcatcccgtcacgataagattccactttatctacgaggggcgtaattcgtttcaactccctgtcactgtgtgtaccaaaaattttagtcaatgcactcataatatattttgctcctaactcgcatagaatataggtattgtaccactttctccacatttacacaactcaaaggccatgaatgttttataaactttttatgaacgaacgggattctgctattgaaaatttgtaaacagcttgctatgataagagaacgattattgtattccaaacacaaggaagaaacagaaaggaaggtaacaacccatgtcttatatttacaaaacaaaaggcacctgttccacacagatcgaagtggagctggacggaaatattgttaaaaatgttaaattcaccggcggctgtcagggaaatcttcaggcaattccccgtctggttgagggcatgactgttgaagaagtggaacgccgtatctccggtattcactgcggcatgaaaaacacctcctgcggtgatcagcttgccaaggcattgcgcgaagcctatgatgcacaaaaaaatgcataataccattaccggattatgtaaaagcctccccagacagatctgtctgggggcttttttatccccgtaccaccggctgcaactgctttccttccaaagctgctgaaatcgtctccggcaaaagttccatttttgccaccatcgaatttggttttttttcataattatcctgtgcgaatggcacaaaataaatatgtttcgtattcatcagcatcccgatatttttaaaactggctcccagtgcatcgttggtggatatggcaattaccagtggtttgccattgcgcatatgcgctttggcagccatcagaaccggagtatcggtgattgcattcgccagcttcgccgcagaatttcctgtacacggtgcaatcaccatcacatccagatatcccttcggtccgatcggttctgcctcctgaagtgtgcggattccagggttccccgttatgtcacagacttcttccataaactcttttgccgttccaaaccgcgtatcacagttctgcgtctgataagaaaagatgggaatcacatgtgctcccatctccgtcagtctctgaatctctttcctggtttttgcgaatgtacagaaagaaccggtaatcccataccctatattgcgatttgataaatccatgtctttgcctctttcctgtcctgcctgattttactgtgttcaagaattgcatctgccagcactttggcactgctctttgtcgtatacagccccggaagtcccaatgccgccacaactttgattccatatgcctccgctgccatcagatccgtaccgccgggtcttgatgcaatatcaatgatcacggcatccgaatgcatttcacggatcatcggctcacggatcacaagtgccggaaccgtgtttacaaccgtgcgtgccccatatgcttcctccggtccgtatgaaaaatcgactgcctcatgtccttccgttcgtgccagccggcgtgcctctgcactccttgccagcactgtcactttcgctcccatcgcagacaaaaccctggcgatctccctgccgcatcttccatacccgctgacaataattttctgctcccgaatagaataatcactgtattttagaatttcagcaaccgttgcttctgccgtaatacatgcgttgcggtgcacaaccaccgcatctgtcatcatatcataatattccgttcccgcatcctcacagcgctgcctccattccggtccgaaaattcctccaaacagcatccagtccctttctttttccctcgtcagttcctcctttaatataaggtttacatcatggtttctctcaatctttgtaacagaaaccggcagcacaagatacctgctgttatccagcactttcagcgcctcttccttttccactccccgtctccagtccagtcggtgtatctttcccggaagacatgcggcaagattgctttgtcgctgatccgtaacaaaaatcacgatatttccggtcatataaaaacgctcccttccatataacatatgaaagagagcgtcataaggtgcagaatcatttattactaaagtctggtttctacaaagatatcgtagattgccttgatggcagcctcgaaatcgtcattgctgacaccaataataatatttaactcggaagatccctggtcaatcatcttgacattgatgttcgcatgggccagtgcagaaaagattctgcctgcagtaccgcgggtagatttcattccacgtcccacaaccgcgatcagacccagatcagcttccagatcaatcacatccggatgggtcagacggcggatggagctgatcacctgctgctccttgccttcaaactcttcctgatgcacaaatacagtcatggtgtcaataccggatggcatatgctcgatcgaaattccgttttcctcaaatgcctgtaatgctttacgacagaagccgacttcggaattcatcatatctttgtcaatgcttactgcgacaaatccttttttaccggcaataccggtaatcgtgtattccggtttctggcaggtactctctacgatcagggttccctctgcctccggatcattggtattgcggatattgatcggaatgccggcctttcgtaccgggaataccgcgtcctcatgaagtacggaagctcccatataagaaagctctcttaattcgcggtatgtgatcacatggatcggctgcggattgtcaatgatacgcggatctgctacgagacatccggatacatctgtccagttctcatataaacttgcatgacatgcttttgcaacaatggacccggtaatatccgaaccgccgcgggagaatgttttcacccttccgtcagcaccaattccataaaatcccggaatgacagctttttcacattcagaaagcttcttcgccagaaccttgtcggtcttgtctgcatccagatttccttcttcatcaaaaaagattacggttgcagaatcgataaactcatatccaagataatctgccataagaataccattcagatactctccgcgggaagccgcataatccgcgccggccttttccttaaagtttttggaaattgtcttaaattcctcatccagcgtcactttcaatccgagtccgttgataatggaatcataacgctctttgatcttcatgagaggaacacggaactcctcgcctgcctctgcttttgcgtagcatgcatataacatatccgtaaccttggtatccttggaattacgctttccaggagcactcggcactacatattttctggattcatccgcacggataatatcgccaaccttggcaaactgttcggcactcgccagcgagctgccaccaaattttacaaccttaaccatttttaacttttctccttcaagaataataacttctgctattatacttctaccgtctggctttcgtcaattattttcttccagatagatcacatccgttgcgatcgtattgcttgatccgtccacctgcagaatcccataggatggcggtattccgtaaggcggctgtccgatgcttcccggattcatataggcgatccggttgtgtttgtcataaaaaacccggtgggtatgcccgaacagcgcggcatcgaccttccgctcctctgccgcatattccagattcagatatccggcttttacattaaatgtatgtccatgacagatcagtatttttttcccttcgatcagaagaatccgttcctgaacttcctgacggcaatcacagtttcccggcacctgttccatcacagtcataggaaatttccggtgcagctgttctgcatctgcccagcagtctcccagatgaatgatcatatccggatgtaatcggccgactgccgtaaccatattatttacatttccgtgcgaatcactgagcaccagaattctcttcatataaaacatactccttttcgtttaaaaagcaaaaagacctttgctccggcatcctcgccaaggcaaaagtcttatctccttctcatttcagcgatgactatcccagtcgcttccactgcttactacatttgtagtaggaataaaacatgcagtgttccgcctgctcgcagcgctttggtgcagtctcaatgctgcactggcaatttacaattgcatctgccttccccttacaatttccctttaacatgacatcgtctaaaacttcatctgacatacttctttttgctccttattactaccaagttttgttcacgacgatcttcattatacaatatatggtaggtaaagaccataggtcaaatctcacaaatagacctgcctgttttataaaaattttcacttgacgaaacagggaaaatgcgctagagctccagcttatttattaagttcaaattatacttttccaccaattccatgcattttctgtaagaatccatatcctgaatatgtctcacacaatgggcatccaatccgagaatcgctttatttccgacttccccggcaatcttccagaaacgctctgccggataatgccttgccccttctcccatgccgagcatgttgatctccaacggaatgtccagttccttcatttctttgcacaaccgggtcatctcccagtcatataccgaatccattccctgataattcatcagatccggatgggcaagatatgcataacttccggtctgcatcccttcgattacaagatccacatatctgcggatacggctttcatcctccgtctctgtcccggtatacggtccgttttcttccgatcccaggaaatgctgccccatgatcatataatcacatccgagattgcggaacatccgcatctgttcttcgtaaaattccggaacatactctgcctcaaatcctgcatatatttttatctgatcccggtactccgcttcgagccttcggatcgtctccacatattccggtgcctgtttcatggtcatccggatattggatacatatccgtcctgataggggcacggcacatgatcggaaaatccaaaaatttcaattcccatggaaatcgctgcctcaatatattctctctccgtatcataggcatgctggcaccgccatgtatgtgcatgataatttgcttttaaaaattccattctgttgtccttcatccgtttattcgcctatcattttaacatggaatacgttttatgacaacaaaagaccgtgtgcatcctctcacacggttcttccgtaactgatcattaattatggaacatctgctgtcccatgataacgttctcctgattttttgtactttccgacccactgtgctctgttttcataaaaaacagtgctcctgcaatgaaaagaaatacgatagcggataccccgatgtttatactcccaaaagcctgggaagccagtccgaccaccgtcgttcccataaaggatgctccttttccgcagatatccatcagaccaaaatactctccggaacgctccggcggaacaatttttgcaaaataagaccgggacagtgcctgaatgcccccctggaacattcccacaaaaattgccagcacccagaactgccactgtgccttcataaacacagcaaaaacggtaatccccgtatacgcagcaatacaggttaaaatcagctttccggtatcgtatttttccgcaagcctgccaaacagaatggaaaacggaaatgcaacaaactgtgtcacaagcaatgcaagaagcagtcctgtggaatccagccccagggcagaaccatacgccgttgccatatctataatcgtatagactccatcaatgaaaaagaagaatgctatgagaaacagaaagattttcttttgtttccgtacactgcgcagcgtttctatgatacgtccaacgctttccctcatggcatgcggtttccgctctacataatgaacctggcgatactgcttcattaaaggaagcgacatcacaagccaccacaccgcaaccactgcaaacgcaatcatcattcctgtttcaaaagaaaatcccattttctgatacccaagtacaaaaacaagacttacgatgaaaggaatacagcttcctgcatatccccaggcatatccggaagaagaaacccgatccatccgctccggggctgtcacatccgaaagcatggagtcataaaaaaccagactggaattaaatccaacctttgcaatgataaaaattaccagaaacgaaatccaccatgtggtcagtcccatcagcagacagccggcgcacccgaccagaatacacgataaaaagagcggctttttgaatcccctggtgtctgccagcgttcccataaccggtcctaaaactgcaacaatcagtgtggaaatggatgccgcatacccccagtatgccagataatccacatccgaaactcccgcattttgcgcaagataattaaagtaaacaggaagtattgtggaaaccatcaaaacaaatgccgaatttcccacatcataaaagatccagcttttctccttttttgtcaatttaaactgcatgttttacctcttttccattttgtacaacctcttttccaaccagctgtgatccaaaactataatcaaagataggttccaatcccctgctcccatccagataagtgccaaactggctgatcatccgcagggcactgagttttgcctgacggtaatactgcatcagctgccggttgctgtcttcacactgtggatttttacggtaatttacaagcagaccgtgcatttctttgtaattcccggaaacatacaaaagtgcataaataaagaaccgcctgattctggatggcgcaatcagcatgttattataggtgatcattccttttaatgcttcccggacatttgccggtgtcgttttcggataaaaccagcggatcacttccgcattttccatacacggaacaatatgttccgtcagattctgccgcaacggatctttcccatccataagcataagcatacggtcaaactctacttcaatttccgtatgggaaataccacttgctgcaattttctcatcaatatacccatggcagcttacatcaagcgcaaaatggttaagcactccataggtgtatgccagaaatggttctttttccttctggctattaattatatttttggctctttcaaaaaattcttttccggaatgtccatgcaaatcatatccgatctggttgaccggattcggtcttaatggcttatagtaaaacaaaatatccggtccgtgaagtccgatcagatacagctgtggatatttttcaatgatttttctctcattcccttcgagttccctgcggacctgctgtccaagccggtaatgtgcatacgttgacggcatgattttttctcctcttttccctgtcatttttatatctaattatatgccggctctgtaaattttgggatggtgcatgtataaaatgcaggtaaaatttatataatttgaccttttcccaaacgtagcatataataggaaaaaccaatggacatgtatgattcttgggggggatatccatgattacaatgttagcgaaaatctttatcaaaaaccgtccggcaaaagaacaacggcaggcatatggcaccctgtgcagtatcgttggaatctgcttaaatgtctgcctgtttgccggaaaatattttgccggaatgttaagcggttccgttgccatcacagcggatgcattcaacaacctgtccgatgccggttcctcttttattacactagccggatttctttatgccgggaaaactccagattcggagcacccgttcggacatgggaggtttgaatatgtgtcgggatttgttgtagcgattgctatcctgatgatgggatttgaacttttaaaaacttccttttccaaaattctgcatccggaagccgtagacacaagtctgcttgccatgggaattctggtatgctccattctggtaaaaatctacatgtactgttacaaccattatattgggaaaaaactcgattcggatgccatgcaggcgaccgccatggattcgctttccgacaccattgccacctctgtggttctggcagccatgattattatgcgcctgacatccatcaatgtcgatggatttggcggtctgctggtagccattttcatcctctatgccggaataaaagcggtcaaagacaccatggatccgcttctcggaaaagctccggaccagacatttgtccgggaaatccgtgccattgtcatgtcccatcccaaagtacacggtatccatgatctgattgttcatgactacggtcccggccgccgcatgatcaccctgcatctggaagttccgggggatgaagatgtctttcagctccatgacatgatcgatcacattgaacgggagctggatcagaaactcggatgtgaagccgtcatccacatggatccgattgaaaccaataatgccgcaattgcccagatgcagcagcaggtagaacaaaaggttcttgaaattgaccgccgtattaccatccacgatttccgcctgatcaactgcgatacccacacaagcattgcctttgacgcggtcatcccctatggtatgcggatccgtccggaagacctaaaggaaaaaattgaaaacaagctacaggaaatcgaaggaaactaccagtttatgattcatgtggatcagagttatgtacctgtataaaaataacggttcgcagatttccgcgaaccgttattactgacagctttatttattgcatgcctcgtaagcatcctgaaagaaaatctcctgtgagtttacaggctcctcattgatatgacggtcctcataaatgccttcggcattctgctcttttcccttctcatcatctttcatgatggtatcaaagatataccggatgcgctcccggattgcaggatcataaaccggagctgccacttccacgcggcgcaccgtatttctcgtcataaaatcggcagatgcaatgtacatcttttcctcatcccccacaccaaaacgataaattctggaatgttcgagataacgtccaacaacggaaatcacccgaatattttccgtcacgcccgaaatctgtggcttcaggcagcagatgccccgcacaatcagatcaatctttacaccggtctgggaagcctcaatcatcttatcaatcaggactttatccgtcagggaattaatcttaaccccgatataagcctcttttccggcttttttatttgcaatctgctcctccatcatctcaaggactttgttctgcaggcatttcggtgcaaccagaagttccgaaacctcatccaccgtttctccctgctgtaatgcaagaaacacttttgctgcatcggcaccgattgcctgatttgcggtaatcaaagacaggtccgtgtacagtcttgaagttttctcgttgtaatttccggttccaatctgcgtgatgtacgcataactgtccccttttttctgtgtgatcaggcaaagctttgaatgtactttgtaatcgcccagtccatacagaatctggcagccggcatcttcgagccggtgcgacatctcaatgttatttgcctcgtcaaaccgtgcccgcagttccacaagtaccaccacttcttttccgttttccgctgcctcaatcagcgcatcaatgatcttgctccggtctgcgacacgatacaatgtcattttgatggataccacatccgggtcttccgctgcatcattcaacattttgataaacggtttcatgctctcaaacggataggaaagcagaacatcctttttttccacctgtgacaggatactttcatgcatggataatgccggagtctcccgtgggcttctcttttcatagaacagttctttctggtcacgcagataattctgcaacgtaaaaacaaacgaaagatcaagcggtgtctttacattaataatatgactggttccaatttccagaaaattagacagttcctgctttgcttcatcattgatcttacggctcagttccacccggacgggatccagacggacacgttttttgataagctgctccatcatatcccggtaatccatatcttcgtcatacagatcatgtgcatcaatatctgcattccgtgtcacacgcataatggatttctcgcgaatggtatatttcggatacaattttgaaataaaatgcagaatcaattcctcagacagcataaaacatcccggtctggtcggtatctcaatcagacgtttgaacacactgttggaacacggaacaattccggtctttttctttcctttctgtgatgtcaggagcacaattgcatacagctgcttatttgcaaggaacggaaacggctgctgttttccaatgaccatcggagataaaaacggtgcaatatgtgcgtcaaaatattgttcaagaagtcttccttcttcattggaaagacggttaaaattgataatccggattccctttggctcaagttctcccatgagctgttcataaatttttgcctttttcttttccagcagacagacatgcgctaaaatttcttttacctgttcctcactggtcatgcctgtcttattttcaatcaccttttcttttgcattcatctgcatcatgagcgtgcccacgcgcaccatgaaaaactcatccagatttgtctggtaaatggatgcaaaagtcatgcgttctgccagcggtacccgcggatttccagcttcatttaaaaccctctcgttaaattgcagccatgacaattctctgtttgtataacatttttcggtattcttcatttgattggtctcctgtctttttatcctctgccggattatattttctgcccgtttcagctgcccagccagctgatacagaaaccgattccatatgtgcatgccctaatcctctgcaaaaaatgcctgcatagttacattttcctttgctacctccacaagatttacacaactgtttccgatccggtcaatattatggagcacatcattaaacggaatggtaagtttggaatcgcactttccctttcccactctggcaatatggtttttgcgcattttttcatccagctgcatgatgtcttctttttgccgcatcagttctttgatatccatatccacatccccagaaatcgcacggatgcagcttccgtaaatcatctggatctgttccattgcctttttcagttcctttaaggcttctttggaatacttatgttttcctttattctgttttgccacggtttccatgatttccctcgtcagttgcccgatccggtcaatatcacagagaatagactgcataccggcactttgtgatgcctgttcctcggtcagcacacctccggaatacagtgctgcaaaataatcattaatggacgcatacagtttctgcagtattttcgccttttcttctacaattcctgcattttctttatcaatctttccgtttccggactgcagttttccgatcatttcatctacaatttttgcgcagtacattacttcttttgccaccagctgcaatgctgctgccggctgtgcaatcagcttgttatccaaatagtttggattttccagtgctttagctcccatttccttcccatccggtacaagtttcatcacaatttttaccatcagaggaatgagtggaatccagatcagcgtcatgacaaggttaaatcccgtatgggcatttgcaatctgccgtgaaatcacatcaatttcgtttcccttcggcgaaatgaactgaatcagggctgcatacggttttacaagaaacaggaataaaattgctcccgaaatattaaatacacaatgggcaaacgccgtccttctggcatcttttggctgtccgatggaagccagcactgcggtgatcgttgtaccgatattgtctcccaacagaatcgggatggcaccggtcagtccgatgatactggtcacaccgtccggtcctgcctgggctgcaaaattctgtaatacggcaatcgttgcactgctgctctgtacaacaagtgtcataacggcacccacgcataccccaagaatcggaatatgggatacttttccaatcatgttgacaaaaaatgcactggatgccaatggtttcatgacatcgcccatcgtctcaattccaaggaataacaaaccaaatgcgaaaattgtctgtccgatatttttcaccttttctttctttgaaataaaagaaataagaaatcccgcaaaaatgaacagataaatataatccgttattttaaatgcaataatctgcgccgtcatggtcgtaccgatattggcaccgagaataatggagatcgcctgtggcaatgacatcagtcctgcactgacaaagccgattgtcataaccgttgttgcgctgctgctctgtaacaccgctgtcgtcaaagcacctgcaagtacaccaagaatcggattttttgtaagcagggcaaggattttcttcatcttttcccccgctgctttctgcaggcactcgctcatcatattcatgccgtaaataaagattgccagacctccgaccagtccgaaaataattttcatcgtctcgttcacttatggttcctccccatttcttttcataaactttacactccgtatactttttttctgagattgtaataagtttatcatcggagtgtaaaatcaaaccatcccagaatgtaaaccctgtgtaaaatttctgtaatgctgtaaaattgctgtaaacttgcgtaaagtctgtaaaatccctgtaaatcggtattttcacgttccatggcatgaaacccattgtaaaaatatttccacaatgctagaataaaatagttacaaaggaaaatgttttggaaagggaaaacactatgctatcatgtccaaactgcggaggaaatctcaaatttgacattccttcccagcaactctcatgcgagcattgtcacacactgtttgatccttatgattttgatgggaaaacaagtgatgccgaagaatcaaagacattcgacggagattacgaggtcacgatctttacctgtccgcagtgtggcggtgaaatcttaagtaccgacaatgcagctgccggtttctgcagtttctgcggagcctccacgattctttacagcagaatcagtcacgaaaaacggcccaattatattattccgttccagaaaacaaaggaacagtgtaaggaagcgtacgcacgccgtatgaaacattccatttttgcgccaaaagaactccgcgatccttcttatatcgatagtttccgcggaatttacatgccttactgggcattttatatctcccagaaaggttctctctcgctcaatgggaaaaagacttcccgccgcggtgattatattattaccgatcactacgcacttaccggggatctggatgcctactacaaaggtctttcctatgatgcctcatcctcttttgatgacaatatcagtgaagaactggctccttataatttaaaaggcatgaaagcctttacccccgcctatttaagcggattttacgcggacacttccgatgtggatgcaaaagtatatcagggcgatgccgaatacactgcatctgcggaaacaaccgagcgtattgcttctgacgggacatttgccgattttaccatggataccatccgtcctgaacagctccatacaaaaacagaaaccatcgacagtaccatgtttccggtatggtttctatcctaccgccaaaaagaccgtgtcgcttatgcaacggtcaacggacagaccggactggtcgttgcggatatcccgattgatccgaagcgttatctgctcggttcgctgcttctggcaattccgatctttgctcttttggcatggtcggcatttttacagccctcttccctggtaatgactaccctgcttttgtcactgctttccatcggtgtctattgttacgaatgcgtttctatccaccaaaaagataccggggcaaatgaccggggcaaaatgttcatccaatcgaagaaagcttctgctgcagacaaaccgaaaacccctgaagcccagccggagccagccgcaaaaacgaatccgcttggctggattcttccgctctgtgctgcggtactttcgtttggggtatggttcctgcatccggtatcggatctctactattacggagccgcaattctttccatggctgccatcctcgtatcgttcatcagtattatccatgcgtataatctgttgtccacccgccggctgccacaatttgacaaacagggaggtgatgaccgtgcgtaaaataaaacgtatccttacggcatttgtattttgtctgatactctccgccagcaccataccggtttgtgcatccgcagtttccgcttccaatgaggaaaccggctacgtttatgtgctggatgattctgcggattttctgacagactcccaggaaaacagtctgcaaaagcagctgtatgacctgacagcatactgtaatgtggcttttgtaaccacaaccgaacacagtaaatcttccaccgaagattttgctgcagattattttgatgatgtctttggtccgcatgacaacggtacgatcttcgtcattgaccgctgcctgaatgagatttatctctacagcgatggacaggcgcacaaaatcatcaccaattcccgcgcacgttcgattaccgataacacttatacctacgcgcgcgataaggattactatacctgtgcgtacaaggtctttgcccagatcgaaacgctgatgcagggcaaacggattgcagaaccgatgcgctacctctgcagtgcgctgctggccattgttgctgcactgtttctcaatctctttttcgcgctgtggagttcacgttcccacaaggcagaccgcagacaggtgatgaccggattatatgcacagatgcagatccataacccacgcacacaatttatcaaccagacgcgcacctacagtccggtatcttccggcagcagcggcggtggacattccggcggcggtggcggtggtggcggccactccggtggtggcggcggtcacagtatataatcctgtagaaaatgcgcatttgtggtaaaacagtgttttaaaaaatgcgcatttgtggtaaaataacaatataaaaaatgcgcatttgtaggagatgtttatgtttaagcgaaaaatatatgacaagctcttagcctggaagcaggaatctgcaggaaaaacagcactattgatagaaggagcccgtcgaattgggaaatctactgttgtggaagaatttgcgaaaaatgaatatgacagttatattctgattgacttttccacggcatccaaaaatgtccgtgaactttttgaagatgtttccgatttaaattatctgtttttacaattacaatttcaatacagaaccgatctgatagaacgaaaatcactgattatttttgatgaagtacaactttgcccactggcaaggcaggcaattaaatcgctggtcaaagatcatcgctatgattacattgaaacaggttccctgatttccatcaaaaaaaatgtgcaaaatatacttattccaagcgaagagcgaaaaataagtatgtttccgatggattatgaagagtttttatgggcgctaggcgataccacaactccggttcttttgcaaaaattatttaccgctcaaaaaccggcaggcgagagcatgaatcgaaaactccttcgggatttccgtctatatatgctggttggcggaatgccacaggctatagatgaatatatccagacgaacaattttcgcaaagtggatgctataaaacgtgatattttaagtttatatgaggatgattttaagaaaatagatgcaaccggaaaactctctcttttatttgactccattccagcacagctgaacaaaaatgcttcccgctatcaggtatccagcgttctctccaatgaaagagctgacacaattttagaactgattgcagaactgaaagattccaaaactgttctcgtatcctatcatgcaaatgatccaaatgccggcatggcaaccaacaaagatttatcaaaattcaagttgtttctctgtgataccggattatttacgactttaatgttcaaagataaggattttacagaaaatattatttatgaaaaacttttaaacgacaaacttggaacgaatcttggatatctgtatgaaaatgtcgtggcacaacttctgcactccaatggaaacgagctgttttaccatacatttatgaacaaaacctcacatcataactatgaggtcgattttcttcttgcacaaaaaaataaagtttgcccgatagaagtaaaatcatccggttataaaacacataaatctctggatgcattttcactgaaatattccgaccgtattctacagaaatatctggtatacaccaaagatttctgcaaagacggtgatattatatgtcttccaatttatatggttccttttataaatcagagcagcttccgcagccccttcgggtagtgattcttcatcacagaacccgcaagttttccccagccgagactgtatccatctaccgtgatcagataccagcctttctccccttctgccggaaacgtctgcccggacagatacgcgcgtgcttcatccacagacagattccagctgtgacatgcttcctgcggagaaattgcaagcgccagtgcgtgtgccggttccagccggttctttttaactgtgccaagatgcaggcccggacgcagcacatgcagccgtctggttgccggcatatgttccggcatcagatacagctgctctccaaaaagaaacagccgcccggcatcatctgccggtatctttccaagaaactcctgtaatcctgcaagatacgcttttgcttctccctttgccagcggtttttcttctccattcgcacaatatccccggtaattttccgaaacggttccctctttttccagaaccgcaacgaaatgtccctctccgtgcagatgatgcggaaataaccggatcgtatctcctatctccgctgccggatgttttgtccatgccgctacaccgtctgccattcccggatattttttcaccggcacaatatgaaactgcggatgctgttccagaaaacggctgatcgttccctcgttttcctccggtgcaaaggtacaggtagagtaaaccatacgtcctcccggccggagcatggaggccgcacatgcaagaatttcctgctgccgcgccgcacagatctgaacattttcaggactccactcctcacacgcctgttcatttttacgaaacattccttccccggaacacggagcatctaccatgatccggtcaaaatattccgtaaacattcccgcaagtgtctgcggactctcgtttgtcaccatcacattttttacacccatccgttccatattctcggaaagaatctttgcccgcgccggatgaatctcattactgacaaggagccctttcccctgcatcgctgccgcaatctgtgtacttttgccccccggtgccgcacataaatccagaactttttcgcccggctgcgcatccagatatgcagccggtgccatggcactcggctcctgaatatagtacacgcccgcctcgtgatacggatgttttcccggctgatcttccttttcgtaataaaacccgttcgcttcccatggcaccggctgcaggtgaaaggaagtttcctcagcaaaccgattccggtcagtttttgacggattgatccgcagtgcctgataacgcgcatcttcgtaactgtttagaaatgccgggtattcttcctccagcatttgtttcattcgatctaaaaaaagttgtggaagcatatcatttctcctaaatttctcctaaagttttccaaaaaaacttggcaaaatatccaacaaatagtaaaatataaatatgatacaacgaaagtacatgagaacaagacaattaaaaccgggcatgaagctcgatcatccggtcgttgaccgtctgggacgtaatctcgttgccagaggtgccgaactggatgattatatgattgattccctgttgaaactgggtattatgtctgtttacatccaggagggggaagaagaggaaaatccagaacaggttcctacttctccggaagcagaaaaaaatatcgaacggctccgtaccgaagaccgcgcaaaagttaccctttctgccagtatccgtgaacgtgtgtctaccggtatccagtttatctacaacaatacgacctccgaggaaatggttgccaccacagagagcattgccgatgacctgatgcgttccattaaaagcaatgatgccatcgcaattgatatctccacgctcaaaaccagtgacgaatacaccttcaaacacagcgtggatgtagcaaccatttccatgatcgttgccaagcagcaggaactctctcccgaagaagtacgggaaatcggtgtctgtggtttgctgcacgacattggaaaaaccaaaattccaaatgctatcttaaacaaaccgggcaaactcaatgatgacgaatttgccattatgcggcagcactcgacatacagttacaacatgatcaaggatcgtgcggaattttctccggctgtctgccttggtgttttgcaacaccatgaaaagatcaatggaagcggatacccgatgggtgtgtctgcggagaaaatctgcccctatgccaagattctgtccgtagcggatatctatgatgccctggttaccgaacgcccctataaaaaagcctattcccagagagatgccgtggaaatgattatgtccatgaccatggaactcgacataactgccatgaagagcttccttgaaagcatgattctatatccagtagacagcatcgtagaactgagtaacggcgaacaggcgcgtgtggtcaaaaatattccgcactatattctccgtcctgtggttgtcgggcttaccagcggtaacgtttacaaccttggagaagatatcaattgtgccaatatcatcattctttaaacaacagggaacagctttcgctgttccttttttattgtgttacctcttcactttcaaaaggctgtgccgtctccggcagaaacgcatcgtagatatccacatgatcatagatacagcgccagctgctggtggaccctgcagtcacacagatatactcttttccatccggtgtctgtgccatacttgccgcacagcttccggactgattcacaaagcctgtctttgccccgataatttcactgtgtgtatccttatcttcaattctccgcaaaaaccagttggatattgtaatcccatccggatgtggtttggattttgatgtcgtgtaggttcgcgttccaagaacttccctgcacagatcattgtccattgcggcttttaaaatcattgccatatcatacggcgtactgtaatggtcatcattgtatatgccgacacagttggtaaaatgtgtggtctccgacaatcccattttttccagttcctgattcatcatatccacaaatgcttcctgtgaaccggccacataagttgccagagagaccgcagaatctgcccctgatggcaaaatggttccataaaacagatcccttaccgttacctgctcatccacttcgtatccggtattgctgcagtcattactataactgaaatctgtggcatcaatactgatggtaaccagctcgtccagctgctccggcttaatattttccgctgctaccagcacggtaaagattttggtcatagatgccggaaccatacgtttcaatgcatcttttccggccagaatcgttccggcatccacatcaatgagaattccctgcttgctgacaacggacttcggaagcgattttgtctctgcggtctccgtagcggaataatcaaatacttcctctgtttccgtcggtatttccgatgcctgctcctgctgcgtcggctcaatcatctttggatcttttttgttctttccctttttccccagcacaactgccaataccagaacaactgctaaaattacaactgctgcaacggctatgtaccatctgttttttcgtttctgcattttcttatctcctgtcctgcctgaattgctcttttgtatcatagcacttttcggctataaattgcaatccatcagatacaaacgagacgcaaaatccggaaaataccgtacgttctcatcatatccggtgcctccgaatgccgggtgcaaatgtacacctccatacatcagagcatccccgtatgcacagaaatcctccgtttccccatccatctttacaaattttgccagcagatgatgtgtcacggaatccgggcggatatgtaccggagcaaccgtgttgaccagatccccaaactccagaatactgtacgttaacgcgcggttggtaaaatggtaccgtttctcttttgcaagtcctttgggataatacgcgtgaaactgtgtattcggttccgcaagtttctgcatcagcatgccgactgcctgtgtctgatcttctgaaacacaggtccattctgtgagatttccgtcagcaaatgtccgcccacgataaaatatgccctgctgcaatacactacgccacttcctgtacagtgcaatctgagccctgatctcctcaagttcctctctggtacagtcacagaaattacattcataccccagcactgcgaatgcggcaactgcaaagcgggtcgtaagcggtgtccggcgcagcgtctgatggttcggacacgcagatacatgtgcactcaccgtcgagagcggatacccgtaactgtaatttgtctgtatgtccgccctgcaacaggcatctgtgtcatcgcttccccagatctgcggaaaatagcacaaaatgccgggatcaaaacggtttccgcctgctgcacacccttcaaataaaatttccggaaaacgacgggtcagttcctccatgcaccggtacagtcccagcacataacgatgtgccacctctccctgctgtgcggccggcaggctctgtgaataataatcggaaaacgtccggttcatatcccacttcacataagaaaccggtgccgaagaaaagacctttgtcatactggcaatgatatactcctgcacttctctcctgccaagatccagaattctctggtttcgtccctctgcatgtggttttccgggaatttcaatggtccagtccggatgcttccggtaaaggtcactgtccacactgaccatctccggctctacccagattccaaaagcaagccccagatctgtaattttttttgctaggcgcgataagccgccgggcagtttttttgtattcggcacccagtctcccaacgaagaagtgtcatcgtttcgtctgccaaaccagccgtcatccaccacaaacaattcgattccggcatcttttcccacctttgccagctttaagagcctgctctcactgatatcaaaatagcaggcctcccagctgtttaaaagtaccgggcgcggcctgtttttccaatatccgcgcacgatatgctcccggataaacgcatgcatccgccggctcatgcctccccatccatccggcgcataggtcataaaggcctccggtgcctgaaactgtgctcccggctccagtttccacgaaaattcccgtggattgatccccgtaagaagccggagttttccaaaactgctgacctccgcagtctcacagtgatttccactgtagatcagatgaaatccgtaacagtctccctgatcttctcccgttttcggacggctcagcatcacaaacgaatttgcccggctcgacgtggttccggtaaaagaatcattgacaattctgccaccggtcagcgtctggtcacagcggtgcatctcccgcgcccatgcgccgcgaaatgtcgtaaaaatataatcactgtcatcaaaatccagctgcagactcatcagacgggtaagctgtacatcctgactgctggcattgacgatcttcgcactccgtccgatcacatctgccgcctcatagacatagtagtagagcaacagcttcagatcatactgccggtccaccattgtcacacacagctgctgcacttctcccgcacttccataggaacccggaagtccgtccagcgcatcttttttcccggtaataacggcatcttcatagcggaaatccagagtctttgccccatcataaagaatggcctcaacaaacggctcacggatatcgccctttccgtacgaagacatttccagccgcacatcctccagcgaaaaaccggcatgctctttttcacagatattcacatttcccggtgcaaacacatgcttttccacaagaatttcaagatcatccggatgctcgatatgaatagttctcccgtaatacagatgctccggatgtccccccggcagaatggaaaatgcatatgttgtatgtgccgtatccagtacgaatgcctgtccaattttacgaatcatagctgtcatcctttcttttagcagttctcctgatttttaattgctgcattaatctcctgcagctttttctctgtcaaaatatattttttccgaaataccaataccgcgatgaaaagaccgatcatcggaattcccgccatcgtcagccgcagtcccagcaccgaagaatccgctgcacgcgcaacaaccgccgcacttgtatcctgcttgaggttacagagagacagacagatcgctgcgatcagcacggcaactcccgaagccagtttcacaacaaacgtctgcatggaaaaaatcacactttcatcacggcggtgatttttcatttccccataatctaccgtatttgccagaaataccgtggtaagcacagtcagcatgccaaatgccgcaaaaatcaaaaagcccggcaccaccagggctccaagcacagtatgaccgccaatcatcagcacaagcagaatcgcataccctgcgattgccattccaaagctcaggtagaacacacggatactgctcataaacttccgcagcagcggaaacaataccatcatggacaaaatctgtaccgctccgccaaatgtactgaaaagtgtatagctgttataccagctctccccactcacatcatacttgaaaaaatacaacagcagattggacgtaatatacaaagagcagttaatcagtacaatggtgatgacaaccgtcattgcctgatcgttgtgaatcagcgccgaaaacatctgccgtacggtcggtgtttccatatgaaccgtggatttttcccggatcgtcagacaggtgatcgtaataaacagcacaaacaataccgcaacaataagtgcaaaccagcggaaacccgtgcgctcatttccctgtcccagcatatacacacatttcatcgtaataatcgtaacgagagcggaaccgacacccgaacaggaacgcgccatagttgttaaattttcgcgctcttttccgccttctgtaaatgccggaatcatcgaccagaaaggaatgtccatcatggtataggtgactccccacacaacataagtaatggctgcatatgccacaatcccacttccattccatgccggcggtgcggcaaacatcagatacagcacgatcgcattgcacagggttccaaccagaagccaaggacggaattttccccagcgtgttctggtttttgcaacaattactcccataatcggatcgttaaatgcatcaaacacccgcgctgccatgagaataattcccattgccatcgcacttactccgagaacatcctggtaataatacagaatatagctcgccgaaagcatatataccatatcttttccgacagcccccaggccgaatgccgttttttcttttgctgataatttcattgtatttcccccttactcttcccgtgccacctgaaaatgttcacagattttccccgtctgcgcattttcaattgtcaaaattccttctccggcctgtccggtcgtctttacataagtaccgcccatacctccctgtaaacatatggtctttggaccgatcagttccagaacacctttcacttcaaactgcaccggttcattgaaaaatcccagcacatttccattttcatccaatgcccggatacgaaccgccgccatatcataggttctgccttcggtcaggttatgtgcacttaccttcacctccagatgtgcctgctgcatcggctctttgatcacggtctttaccacttttccgtccctgacagcctcaaacttatagaccgtggaagtcgtcccccagtccccgacataacgtgtgtaaagcgcaaccgcatcctttggtttcatgtgatagcagaccatcagccgcaatgccagaaggtagaactttgccggaagattgttcagcccgtaatacgccgtcatgttaagcagctgccccatcagtctggcctgtttcggtttcatcggctcattttcgacaatcgcatttccgataaagtcattcacaggaatcggtccatgcgccagtgcacgatatggggagtcctcccgatgatactctttgatcaatttgccgtttttgaacatccgcacagcatccgcatttgtaatcatccagtttccgctgcgatttccgcccggatgctctccgatatccatcgaagaactcagttctaaaaccggtgtatcttcctgctgactgctatacaccgccgccgcaagtttcgggttgcggaacatatccatcacgccatggtaacagatccggtcaccgctgccaaaatccttgtgcgtattatagtcaaacatacaccagccaaaacttcctgcaatatccggctcctgtgccaccgcatttaatacatttgcatgacggattgcatgctccgtccggtgttcctcatcgtcaaacggcttggtcggaaacatatgcccgttatactcactgatcagatacggttttttcatatccggtgtaacttttcgtttcggattacaccccggatgtctgccatcgtgaagaaaatcgttgtacgtataaacatcctccagaagatggcttttctttagcatccgcactccgccggttgcccgcgtatcgtccagttcatgtgccacccggtttgtttccctgtaaaaaacatcgtcatcctgtgattcattaatccgcacaccccagagaataatggaaggatgattgcggtactgcacgatcatttcctttaaattctgcaccgcctgccgcttccattcttcatccccgatgtgctgccaccccggaaactcggtaaacacaagcagaccaatttcatcacaacgacggataaaatcctgcgactgcggataatgggaagtgcgcacggcattcacgccaagctcttttttgagaatatcggcatcgaaaatctgcatggatgccggcgctgcatatcccacatacggataactctgatgacggtttaacccacgaagccgcagtttctttccgttcagataaaaaccatcttttcggaatccggcctcccgaaaccctgtgatatccacacgcgcatctatcattttcccatttttccacaaacttgtccggatttcatacaaatgtggattttccggttcccacaaacagatctcctgcaccggaaaaacgatttgcacatttgcctgttttaccggcttctgtcccaggggactatatgcaccctcgccttttttgcggatttcctgctgcaacgttatcccatccgaaatattctgtaccgtaatctctgtagtcacctgcagaggatgtatctgtgacttgacaaatacatctgcaagatgtgtcttatttctcacctgcacgtaaacctcacgatacatcccgccaaaagtcatgtaatctatggcatatccgaacggcggaatattcaaattttcccggctgtcgacacgcaccgcaagtacattgtcctccccatatttcaggtattttgcaagttccacggaaaatgccgtataaccgcaatggtgcgctttcacttctgtcccattgacataaacaaccgcatcatgtgccacgccctcaaaggtcagttccacacttttcccctgccacgcttccggcgccataaaatgtctgcgatatccacacagcatctgatacgcatgctcatcaaagtaatgatacggaagctctttgcaggtatgcggcagccgcacatcctccatctcattttccggatatactgcctctttcatggcttcttcccatgtttcggcaaatttccagtcattgttccaatacaacctctccatgcttctttatgctcccctttcgttttacctctccgaagcaattccatacatcagaatcccgacaacctcctgcaatgcctgcgcataagtaatttcattctgcagcaggatatcgcgctggaaaaactgctctaacgatgcttccagcatcatctttaaaatcggaatccggaccggacggatcacaccttcctgcatgccctgttccaacagggcaatggtcgtttcccagcctgtttcgagccgtacttccacctgatgataaatctccggatatttttcttttaactgatataactgtcgaaaatccacatcctgataacattccggcatcacaccaaggattgtgtgaatcttttgcagggtatccatctcctgattctctacgatcttctgctcactgtccttgatccggtcaaacaaatagtccaccgtttccagaaacaaagcctccttatcacgaaacacttgataaatcgtttttttactgatccctaaaatctttgcaatatcatccatcgtaaatttcaaacccttttgattgaatgcctgcaacgttccctgcataatgttctctttcagttctttattcattcttttcatcctttctgccggaaggaaactattttctttgtttcagtttccattatggtagcatgttctctttctttcttcaagaaactaaatgcccaaaaatcgtttccgatttttgggcacattttttgcgctgcgttttatccccgcatcaattccctgcgcaccgtttttctcacaaaataaaaacagatgacctgcatcacaatcgtgatgatccaggatgccggataagaaataaacaggaagtacaacgatttgtgatgtgggaaaaatccaaaaatccagagaattctcgttccgaccgtaccgatcaccgacaggatcatcggcactgccgaatgtcccatcccccgcagtgctccaggaaacaaatccataatgccacacagaaaatacggcactgttgtaatggcaagaatctccatgccactctcgatcacatccttttctctcgtatatatactaagtacctgcggtccgaaaagccatgcgccacatcccagcagcaggggaacactgaccgtaagaatcagacagtcgatcagcacacgatccatacgtttatattttcccacaccataattctgactcgtaaaactcatacatgcctgtgtaatggaatttaccgacatatacaaaaatcccaaaatattatttgccgctgtataccccgccatcgccgtatctccgaaggaattcacggaagactgcagcagcgcgtttgaaaagttaataaccgtactttgaatcccggcaggaattcccacctgaaaaatctgcagcagataaaccttttttattttcagcttcgaaaagcgcagctgatagcagctgtcggtgcggtacaggcataacaaaaccagaatgcaggagatcatctgtgccgtaatcgtcgcagtggctacgcctgccacccccagatgaaaaccgatcacaagaatcagatccagcagcgcattggcacatccggaaatcaccagaaacaacaacggccgcttggtatctcccaccgcacgcagaatcgctgccccataattatagagcataaaaaacggcatccccagaaaataaatccgcatgtaaagggttgactgtgcaatgacattgtccggcgttcccataagaagcagcgcaccttttgcactgattaccccgattcctgccatgagaattccgctgatcagtgccagcagaatggcggtatgtaccgtgtctgacatttctttttccctgccggacgcaaaaaaacgtgccgcaagcacgttagcccccagcgaaattccgataaacagattggtgaacacgttgatgagtgccgtggtcgatcccactgccgccagtgcctgttttcccgtaaagtgccccacaacaacgatatccaccgcattgaacatcagctgtaaaattccagacagcatgagtgggagtgcaaacgagatcagtttatccatgatcgaaccattgcacatatctatttcatatttgtttgttttcaaattttctctatcccctttctggttctgttatccctctgagccataaaatacgccgctactggcggcgtagttgtttgtccttatacattctctgatctgcgatctcgatcagttccattatattttcatattttcccacagcatatcccacggaggcagataccggaatctcactgtttttctgaatcggcttcatcacctgcctccacttttcaatgacatcttctgcaatctcctgtgtcccatccggaataatcataagaaattcatccccaccgtaacggtaagcattggtttcctcactcgtcactgctgcccgaatggatcccgcaattttggcaatcagctggtctccgtacaaatgaccaaacgtatcgtttacatatttcaactggttgacatcccaataaataaccgcaaccgggcgttcttttggctccatatgttccactgtttcaagcagtttatttttgctgtaaagtcccgtcatatcatccatggaagccgcctgtaccatacgtattgcattttccatggacttgcgcacaatactgtttacactgttacttacataataaaatgcaaccgccatcagcgatcgcggcatcacataataaagtgccagcgtaaccataggattttcgtttactttgttgagcaaaaacacaccatccttctgcagatgatccagtgatgtcaccgtcagtagtgccatgtttgcatcacataccccaaaataatagcccacataagtactgatcgtaatcccacccactgtaaatataaaggcataaaccgacagtctctttgaagtatacatacttgcaatgataatcgggatcatcataataatgatcatatggtaggtaagggatgcactcgcggccatgacgatcaacccgatggccgtaacgctgagatacttggtaaatgggtgctcaagccccatcttcacaagcagcaatccataaatcagtgtcagcacacatgccgccacatagcctctggtaaaaatcgcctgatccacgataaaaatatgcaggcagttcagaatcatcacaaacgaatagaataaaatgcagattcccaccacacggaacgcaaaaatattctgcgtcacatcctcctgctcgtaaaaagcatttttatttgtaattttagataacagtgccttgcaggtgctcatccatatatcctccagctttgtctgcctttagtataacatattcctgcatgagtttcactactttgatgaacttataaattcatcaggaaaattttccataactttttgtcagtgttctgccattttttctatcgtgccatgcataacggaatcagtccctgcaaatgaaactttgtctatgattttacataccacatcaataacctttgtaagacttacttcttcatcacgacgtaattttgtcatcgtgttaggagcaatttctgcctttttacgcaaatcagatttgctcatttttttatccactaataatttccataatttgttatatgacacagccatagtatttacctattcacataaatctttttctgcttcatatctacctttgcaacagcaccatactgtaacgcacatcgtggcatagcatgtccgaaattcacattataaacaatcggaagtttctcattgtctatcactctaataagaatatctttatattcctgataataagcttcatcctgtggttttccaactaatacaccatttaccacgtcgaatactcccttttctttcagtaataacacttctctttcaaacaattcaggagtcggtttttcttcgcaggtttctataaatagaattttcccaatccactcttccttatttggaaacagatcatatctttcacaaacttccttttcatcttcatatctgctattggtcaatacatcataaaggctttccaaacatccgcctaataatcctccttggaaaatttcacttccctggagaaattcaaacccacgttcttccttatgagcttttctttctgtccctattgcggctcttgaaaaatcttctctttcttcataccaaatatcactggatataatttcatcagattcattaccttccaaataactctcaaatgcccttttggtatatggtaacatctcatctgcaatttcccccaaatcacaaataaagtttggtccgtaataagtagacaagcccagtttataaaacatcaaatgattgatcgtagtatctgagaatcctgtaaataattttggatgctcctctaccgtctttataaacttttcatcttccatcagataaggcaaaagtctgtatgtatcatcaccaccaattgcacaaataatccctgcaatagaattatccagaaatgcatcttttaggtctttcgcccttgcttgcggatgagcttgcaaatattcaatacccttcaaagcattagacataaataccggctccaaaccatattcttttaatctctttacgccaatctcaatattatgactgcagaattcttcaccgagcattccacttgacaagcttacaattgctactttgtcgccttttctcaattttcttgcatattgcataactacattccttccatagagaaaacaatattactttttatccgcacgctacttacctttaaattccttctctatataacaatgttcctgtttggcaatcaacttaaaactgtaaatcggacattcagattccatttcgttacagctgctttcaaagtccagttcgataatatatggcatccagtcaataattcttaaaaaatcttcacatccaaaattattgtcataaaaattcaatatcgtactaagggcagtaccatgggttcctataacaatatctttatccgtattatctgataaaatctcattcagtgcctctatgttacgtttttgcaccatagcaatggactctccaccttcttcatgataattatggtcagcccagcgtttctgaaacattccgtggttgtttccattaggtcccttttcgcgctccctcaatctctcatctgttataatctcttttgtaaaaaaatctgctgcctctgcaatggtatccatactacgtttatacggactacaataaaacgtatctattttcttatccttcaaaaattccagaacaattgcagaatctttcttaccctcttccgtcaaaggtcttgtcctgtcttcttcccattcgtgttccggctgtgcgtgacgcacgaaataaactcttgtcatttgatcagctccatttcatcttccatttttacgaatccatatttttcatacaatggtcgtcccatctctgtcgcctctaaagtaatctgtgatacgccctgtttccttataacctttaccagtaaatctaatgtatgaaatgcaatcccctgtctccgatatgccggtgccgtatacatattcataatataagcctttttacctgttggattatgatatgtcggcataacccgataaaaactgacaccaccagcgccaataaaggtttcgttatcatacaccagatatgcaatatgctcaccagtttctaatgcgttcttataatattcataggattctttttccaccaatgacatatccacatcattcgataatttatttttgaaagttctctcgttacatcccatccaatcgctaaccgatctgcttcatctttctttaatcgctgataatctttgatagcttttgtaattaatcctccactagattttcatttatatatttaaaataaggtttcttattaacttctgtgctatgttccaaataccatttaacactatccctcaatccgtcttctaatgatatggtttctgggtatattttgttttgacgcgatacatccaaatagtactcatagttgtaaaaactgaaataatttcgctgttcaatatcttcataaacatttacaaaatccggtatttttcctaagctttcatagcattttgtgacccaatctttaatagaaactgcttcaacattaccaacatttaaaatatgctcttgtggcttgtctttaattattacctccatcaacctgcataaatcttttacatgaaagaattgtaatttcatactgccatctttaggtaaatagaattttctgtccgccaaggcgcaatcaaatacaaaagcctctctatacacgttattcattggtccatataaataaggcggtcttaatatatatgcatctttcactctttcaagtaatgccttttcagctgctattttatcggttccatatgaaccccaaaatttattttcggatttctctgattcttccaggaatggctgaacaccatactcaggataaacggcacttgaactaatcataatatactgatcaaaagaacccaattccctaacaaaatcaattatatcgttatcattataggctgttatatccgctacaacatcaaagaatgtatcctttaatacaccacccaaattatgcctatctccttcaatgagttttacaccttgaacttgtggcttagaatttctgttaagtacaaaaacttcataacccacattcacaaaatattctgccacatatttacttacaaaagttgttccgcctgtcactaatatctttttcataaaattctcctttacacaaaaaattcgattgatcagattcataaaacactattttccgtaattgtatcataatcacataatccaaaaaagtaattattctttcttttccaatccttttactatcttatcaaaatcagattctatcggctgtgtcttgttaaaaatatcatattcttgatatgctttctccactgcctgcttatgggaaacacgcccattactgacataaagcactctccccttggcttatctattctgcccatcccttataaatggtttcttgatttctttacttaacaactgactatatgcttctaccttacgaaatgtatttcctaacatttcccgattcctgtattctctaatagcttccatatcaaactccgcataaaaaattccctcagttttatcatcaaccagcaaaactgtgttatcaacacattttccatttctatcccagcaaattggactatatgcgcaggaacatccagcattatctccattcggatttgccatagcaactgcaaccatattttcataagctcttgtagaaagtgccctgagtcttggttgcatagaaccgcaatcatttgggacaagaataacctcagctccttttaacatcagtattcttgcactttctgggaactctctgtcataacaaatcataatacctaattgtattccttcaaaatcacacaccttaaattctttccctgattcaacatctctttcatctgcgaaatcacaggtatgcaccttagagtatttcatcaatatattgcccgatttattgataacaaaggctgagttctgtggctgcttactaccttttgtaaacgcagtaagtactacgcctattttatattttttagcattctcacatattttggcaattcttatatcattatctgcaatgcttttttcatatgacataggcaaatcatatcctgtaataaaacattctggcaacaatagaatatctgcatggttttccgaagcctcttccattgccataatgatagtttcaatattcttatctatttgttcattaatagaacgtttttgtagtatagcaaccttgaacattcactttccctcctatagataattcaaaatgtcagataagttattaacttcaatatcggctttttcactctcgtccattacagtccacaaacttccaaatccctgttttatccatatcgttttcattcctaactgttttgctggtacaatatcattatcaatgcggtcaccaatcattacagcattttccggcttacagccacttctttccaaagcaatttcaaatatacgtctgtccggttttgaaacaccttcttctgctgatgcaatgactaaatcaatatattttcgcactccgagattttctaatctttcagaagttcctaatggttggtttgcgattataccaatttcataatttctgcttaaccttttcaggcaatcttcagaatctgtatacagcttttcatattgtgattcccatttaggtagttctatccccaatcgttttgctatctctaaatcaccttttttatttctcctgtataatgatatcacatgttcataaatttgttgcggagttagactagataattcagctatttttttcatcctatcttcataaactttactttcatcaaccagcgtcgaaccaacatcaaaaaataaccattttatttcatccttcttaggcaaaaatcctctttgtctcgcttcttccatcagtcttggttgaatttccggatatgtccaattaagcggtagttcattcataattgctattttctctatctcactatgtaaatctttttcaaacgtatgtatctccgcgaaaaataactttccaaaggtttctttccccttaaagttgtctggcaccgtcacagaataaatacatatcggatttatctcaaaattaatggctcctgtttcctcatacaattctctctttgctgtttcaagaatatcctcaccttgttctctatgtcctcctggcacttcccatgtacttctttctctatgcttacagaatacccattttccattatgttttgcaataataactgcaaactttagcattgaatcatcaatgctatcataaaaattcactttggtcatataatgctccttattaaatttcttctatttatcatttattgttcccacaaatagagccaaactagagccttttgataaagcaaatgccggaaacccgcataaatacaggctttcggcattttaatccgttattcaaactcttttccgggttcaatttttcacataaatctgctgttattatattgcaaaaccatattattttgatacggttttgtatgttatttatatagttgcatttctggtgaacccaaattgtacccacgctatttctgtacactattcttcattatcaaaggtgtcattttttcatgagtgcatctgcgatacgtctgcttttgtcatcaagaattttcttctgttcatgcgcccactctacagccttaagctgatcttctaatttttcacttaacaaaacatgatcttcatcattcatatgtcttattctcctgttacatcttcaaacaactttgctgacacaatatcctcaattttttctctgaactgcttaagcattgctgtatctccaacaataatttcatcaaagaataaactttcagttgtttttcttagaatcaaatctacagtccccggattcttcaattcatttccttttatcagggacttcggacgtgctttctttgattctgaaaaacctaatgtgcagtttccatccgctgttgccagcgaacacactacccgacttttccgaaagccttcttctacttgaacatccgatttcattagtgtcatcatatccggcaaaacctgtatttttcttcttactgtaccttttgccgacttctcattgtgtcctgcttttgcaaaatcaaagtccacttccgcaagcgttccatcataacatttgcggaaaaatgtcttagcatctatcttggactgcacacctgttaaatgctgaaaattatcttcctctgcagcaattatataataatcatttttctcaaatgttaccgagcaaattagatactcataatcaacatagatgtccttatactgttttgcagcttttatcatttcctgtcgggcacgttccttaaaactttcctctgccattttttctccttggttaaagaaagacggatgaccgaagccatccgcctttgatttttagcagtttactctgtaatgggaatgagttttaggtcttcatcccgaccactggaaacgggttttaagtctcccttccgactgtagtatcttctctttgtaatttaaatatacactatcgtatgctaaaagtcaatctactgtgaatgttgttttatatcacctaatcgttagtaccatccttctccatatcattcatcaatttatcaaagtcactttcatacagtgaatcctgtataactctgtacttctcaaattcactttccgcaaattctttcgcaatagctgcagtaactttccctttatcctgaagtacttctgcatcattaaatctaagaaatgcgtcaagctttgttttccaatcttccatagtcataggaatatgtcttcgtgcctgtcttattgcataatcaagatacattgtcacaatctcatttaattctgcaagttcttctttttctaagtagttttttgcaattgacacatctgtttttactattttaccatccgacgcatttttccatgatttaagtcccatatgttccttattatgatcagctcttgccactatcacttctgccgctgtactaccatgaactgcataatgcatcttattctgtactgttgcataaaactctcttgtcacctgtgaattcttatcataatcaactgctgttgcatatatatctgtaattttctggtaaaatcttctctcacttgctctgatttcctgaatctcagcaataagatgctcaaaataatcttcgtcgaaaatctgtccattaatcaatctacttttatcaagaacataaccctgctttgtaaatgtatctaatacctttgttgcccatgttctgaactgcattgcccgttctgaattaatgcgataccccacagcaataatagctgctaacgaatagaacttataattgtatgtttttccatcatccgcagtttgtgcaaattttgcacaaactgaattttcatctaattcgccctctttaaaaatgttactcagatgttttgtaaccacacttctatctacatcaaaaagctgtgaaattgccttctgcgtaagccatacatcgccattctgaaccctgacctctattccgtcttctcctgcatctcgtgtgaaaactaaaaaatccacagtgctatttcttatctgtaattctttgctcataaaagcattcctttctctagattctatcaatacatctctataaaacattttccccggtttctttcaaatatcaagaagggaatttctgcttttgccagcatactattattaactggaacatattcataattttcaatatctggtatacactttatagctttctttttatctataccatatagattattttcactgctgttccataaagccttaatcttcaaaacaacacattttgtttgaaccatcaccttatatttttcaagcctgcttttttctatctcctttgatttatcaccataagaaatagtaatatatctggaattggattttataatgcgaacatctccattccttactgcctctttagggaatcccaaatcttcaaaaaaactatcataatctgtaatgcattctgggagttccattttgactgcataactgctatttataatattctgtatatccttatcatcaaccctgaacatataaatattccatcccgtgctatcgccatcatcatctaatattggaatagaaccataaggattaaacatatgtaaattagacaaatcatcttttgttggctttttaaatttgactatttcaaatgttatgctcataaatgttctccttttccgtcgcttttttcgtcacttttttagcgacgaattattttatacatcttgcttttcgtcattgcaaactaacttcttatgcccaaacaattgttttaacaattcttttgcgctaatggttagaactgcgattagtatctatgtacctggtaaaatcaattacctttgcaggctttctcttaggaataattcctaatcgttccatgtctaatttaaagagttcacttggatatccatatgcatcgaatccctctggctgacaaatatctctgttaagatactcactcagttcccactgatattttgtatctttctccagtttcttatcaaaatactgcgcatccgttaccattctattaatgccgccaaccgatttcttcccatgtgtctttgtcacaatcatatcgcctgacattttaaaatattgtgctatctgttcttcagaatatcccatttcctgcatcacgccatggatcacgcggctgatatacattgcatagtaattccagtttcttggttcaatatctgtcattgctattgtataacaattactggcatttacaataaacaagacatttcttccttttattttcgtcaaatgtgtgtcccagcagaacacaagtgaaacacctttgctttctgcaatctttgtggtttttagtcgatcttgaactgcctttgttgcaccaatctccatatgtatcacctgctcatttcaagtattctcttcacttccagctgtaattcatcactaaagtctgataaatcatcatatgtaattactttcaatctaataagacgaacgatatcccatatcacctctgacttactcatctccatgataactcccggatgacgcttatcttcttttatccgtttttcaagttcccagaatttctctgatgcaggctttttatcatcattcagaaaatttgcatactctttaacaagaccttccatataattttcctgccagcctgataatctttctcgaaataatttccaatcctttttgcttatgtccatgattttgaacctcctcagtctcatgttatctctgcatttttcaccactgcttcaatgtgataatagcaccccattccaaatttgttagttggttgcttgcacctgtgatatacttctttctgtaaatattctatgatatcagttctcattttttattcctctaaaattcacatatctgttaatagatatctctatgtccctctatttttttatactttcagttatatctttgaaagaagaaatcatatctactacgttgcccatctttcgtgcttttttccttgctattcttctagagtctcctgatatggttgaaaaatcatatgtgaatttttcaataattttcttaattacccacacaacaagagctgttgtcaaaaacgatataatatatggcataaatataataattgcttgcaacatgccatccataatcgctttattcatcatttctcctatatttaccaaatctcaatctcctctcttcttataatgtatcatcaacaaaatttttcatctgtaaatacttttctatcaatttcggctgtatcaaagggtatgtccaattctcaggcaacttatccataagaacaaccttctccatttcgctatgtaattctttcgtaaattccgttatctccgcaaaataaagcagtccaaatgtttcttcgccagtatcatttactctagtcttacctgtcaccgaatatacgcatattggttttatctcaaatttgatagctcctgtttcttcctgcaactctcttttagcagtttcaagaatattttccccagcttctctatgccctcccggcacttcatatgtatctctttctttatgcttgcaaaatacccactttccgttactctgtgagataattactgcaaatttcaatagttcgtcattaactgtatcataaaatcttacttccaccatatttcctctccatgtacatatctataatatttcattctcaataaaatccgcaattccctcttcatcatttgaaccaattacaatatccgctctctcttttacctcatcaatcgcattcctcattgcaacacctgttccacataattcaagcattccgatatctgcataatcatctccaaatgcaataattgaatctgtactaaatccacacacttccgtaatcttcataattgcgttttctttcgtcacattcttttttgtaaacttgtaccaaaatccatcagagaaacgaatacaatcacaatcagagagacttcgagctagcttatctgccttatcttgattaaatatctcaacacacatttttaatgaacattcgttaaaatctgaaaaatctgtataaatactatctccccaactcttatctaacttcttaggatctattttataattccaataatgtgcatctattgtatctatcgtaatttcgcaatcatttccacaaatatttcttgccatgtcaatcatcacattagtttcttcttcggaaaattctgccctataaatatattctgttttgtattttactaatgcccctccactcgatattaaaatatcgggcatcaattcatttaaaaataccaaagagttttgctcacttctggaggtagaaacacctatcaatatatcattttccctgcatttttttagagctgataacgttctagttgatattgttttgtcactctgtaataaagttccgtctaaatcaagtaaaagaagtttgcatttcttcatatcattttttccttttcattcatctcaataattacatttgcatcaattactctccccacaaatagagccaaactagagccatttgataaaacaaatgccggaagcccgcataaattacaggctttcggcatttcaatccgttattcaaactcaatcgtcccaggcggcttactggtaatatcatagaagcagcggtttacccccttcacttcattgataatcctgctcataactctctgtaacacctcgaacggtatattggcagcttccgctgtcatgaaatcgaccgtattgaccgcacgcagtgcaaccgcgtaatcgtacgttctctcatcgcccatgacacccacgcttcgcatattggtgagcgcggcaaaatactggtttggcatccactccggtgcctctccatgctctttgcggtattcctctaccgcagcatccacttcctcacggtaaatgtaatcggcatcctgcacgatacgaaccttctctgcagttacctcaccgataatacggataccaagtcccggtcccgggaacggctgacggaagacaagtttctccgggatgccaagctccagacccgctttgcggacttcatctttgaagaggttgcgcagcggctcgatgatttccttgaaatccacataatccgggagaccgccgacgttgtggtgggacttgatcactgcggattctccgccaagtccggactctaccacatccgggtagatggttccctgtgccaggaaatccacggctccaatcttctttgcctcttcctcaaagacacggataaattcctctccgataattttacgttttttctccggttctgtcacaccggcaagttttccataataacgctcctgcgcgttgacacggataaagttcaggtcaaactgtccgttcggtccgaagacttcctcaacctcgtctccttcgttctttcggagcagaccgtgatcgacgaatacgcaggtaagctgttttccgattgcacgggaaagaagtcctgctgcaacagaagaatccacacctccggataatgcaaggagaacctttccatcaccgactttttcacggatctctttgattgtatgctccacgaaagaatccatgcgccaggtgccggcacatccacagatatttcttacaaagttgtgaagcatcctgcttccctctacggtatgcagtacttctggatggaactggattgcataaagttttttctccgggttttcatctgccgctaccggacagtcagcggtgtgtgctaccacctgaaatcccggtgccggcttggaaatataatcaaaatgactcatccagcagatggtagatccttctgccgaatccgttgccactccctcaaaaagcggagaagacttgtccacgaacacttccgtttttccgtactcacgtaccggtgccttttctacttttccaccgaggatatgattcatcagctgcgcaccatagcacagaccgagaaccgggatgccaagttcaaataattctttcgtgtatgtcggggaatctgcctcatagcagctgttcgggccgccggtgaggataattccctttggattcattgccttgatctgttcgatgtcggtacggtaagaataaatctcacagtacacattgcactcgcggacgcggcgtgcaaccagctgattgtactgaccaccgaagtcaatgacgaggactttctcctgatccatattttgtttcctcctgttttctaaaatgcatttttgcatttatgtggtgcatttttcaaaagtacaccatttttctaccattataataaagcccctgtgattttacaagtcacaacctcacgttttctcgtaaaatgcaatcacatccgcgtaaactttttcattttctttctcattcagtatttcatggcgcatatgcggataggtaattgtggaaatattggaaaaacctgcctgtttcagcatgtccacactgtctttggcacctttttcatacccggtgcacggatcttcgctgccgcggatcatcagaatcggtaatgcctcatttacgtcccggtaatttgacacctgatgcatagcagttgtcagcatatacagatcgtgaaaagcggagacactaaatccgtgcccgcaatacggatctttcagatatgcctgtaccacctgctcatcggaacagatccagtccacttcggtttttgcatgttttatctgcttattgaaatttcccaccgacagttgctgcaccagcttggaatgatacatcggtccacgcgcccttgtgagcagattcgtcaggaaaaaccctatgcggataatctgtgttcccggataattcgggaatccgctcagtaccacctttgcgtaactgtgtgactgggtacaaagcagattccttgcaatgatggttcccatggaatgtgcaaaaatcatcaccttttccgtttgaaaccgctccctgatatatgccgtgatctgtacctgatccgacaacagataacggtcaccgtctttttctttaaagaaccccagcttgggagcatgttccccatgcccccgcatgtccgatgtcaccaccgtaaatcccgcctgccgcagctgctcagcgaaagcctcataacgctccttatgttcctccatcccatgaatgatctgaatgtatccccgcggatgctcacgttcaaataccgccagactcagcgcgtaaccgtcgaacgctttcaatactatattttccatttatatcctcttctccgttcgtacttttaaaaccagtccacatttgttccatgttccaactgttccggtgtcatcaacgacacggcatcaataaacccgttgcgaaacgtcatcgttcctctcttttgcgcggtcatttctttcgccgcaagttctcctgcaatgccagtaaacgcacagcatgccactgcactctccaccgaattttccgcacttaaaaaagcgccaagcatcacggtggacatacagccgcttcccgtaatccttgccatcatcgggcttccattatgacaccggtagacgtagcttccatccgtgatcagatcagcttctccggatgcgacaagaatcatctggttttcctttgcatactgcttcatcagctccggcaaatccgtttcttctgcttccgccagcgcatcctcggctgcatccaccccggtaaccgttccacagttgtgcagcaatgcctgtatttccgaataatttccccggatacaggtcggatggattattttcatcaactccaaacattttgcacgccgataggaagaccccgacaccccgaccggatcaatcacgatcggatgtcccagcgcatgcgcccgctttccggcagtcttcatcgcctcataatccgagatggccccgaaattacagatcagtgacgctgtacctgccgtgatctcttccacctcacagggatggtgtgccatcgttggtgacgcgcctgccgccagaaggatattcgcacaatcgttgaccgtcacggcatttgtgatacagtggataatcggacgtttctgttgtattttctcataaatttccaccactttttccccggaaaatttcatcacagtttctcccgtctttgtatttcaccgtccagaattcctgcctttttcattggaatggtcacgataattgcaatgatcgtaccaccacaggtactgatcaaaaacggcactacaaatgtaaacaatgccgctgctttattccccataatcagatacgcaatcggataagaaagcattccaccgatgataccggttccaaacacttctcccacgtatgcaaacggaagctttttcccatactggtaaagcagtcctgcaagcagtgcaccacacatacttcccggaaatgccagtgggctgccaagccctgtcagattacggatcaatgccgccataaaagcctgtgccagcccccaccatggtccgaccgttaccgcgcacagtacattcaccagatgctgtaccggcgcacattttgagcccaataccgggaaagaaaacatactcccgaccacagccaccgccgtaaaaagtgccgtcaatgtcaatttttttatctgcagatgattcttcattttacttttttactcctcttttgttccctttatatgatctgttctacaagttctccaagatgccgagtgcctgtctcaatatcctcgcaggcaaaaatgccgctgacaactgcgacacccgcgatgcctctgccttttaactgcaaaacattctctgccgtaattcccccgattgccacaaccggaatctttacgctgtgacagatttcttccagcagttcatgtttcatcggaatggcatcctttttggttgtagagccaaacacagcaccacttcccagataatcagcacctcccgcttctgcggctttcgcctgttccacggtttttgccgtcacaccaatgattttatccggtccgagaatctcacgcgcgtgcgccagttccatatcggactgtccgatatgaaccccgtctgcgccgacttttgccgccagttccacatcatcatccagaatgagtttcaccccgtaacgatggcaaagttccagcaattcttctgcctccttctgcacatccgcttccggaagttccttctcacgcagctgtaccagagtggcgccaccttccagtgctttctctacctgctcatataatgtttcattgcccagccaggtgcggtcggtcaccgcataaaggcggagctgttcttttttcatattattcactgttttttcctcctgcatgttatcccattataacacgcacgacaggagaaaatctatactgcatgcaaatgtgcatatttttcctttgttgccattcctccgcggatatgacgttcggatttattcacatcaataatcttgcgggtttctgccgcaagtgccggattcacctggcacagccggtccgtgatatccttgtgaacggtcgattttgaaattccgtaatgcttggcagcctgccgcacagttgccttatgttcaatgatatagtttgcgatttccacggctctttcttcaatataagctttcaaaaaaatacccctgcattcctgtgtttgtacagtttatgcaaggatatgtttgcttattacttactttctgacttacttcccacaaagactcttctgtcacaacctgtcccacaacagttccatcgggtttgactccaaaataaagtttccttttcaataccaagattcaaatcaacacctgccttcaacgcatataattaaattatatactgcttataatgatatgaggtcaaacatataaagcaaatatgcttgtctatgtcccatgacgaactgaatagaggacatatggcaaaaaaatagccgtccatgtcccataacgaactgaatggaggacatatgataaaaaagtgctcatttatgtcccattaaacaggtcctgtgggactttttcatgcgctttttatacatatgtccttttgccaacttctcccgggatttttcaatgcactttttctacatatgtccctccggcaactttcaccgcgactttcaagcttactttttctctatatgtccccaaaacacaaagaaacgcacaagaaaaaggaatgttcccacacagaaacattccctctttcattatgtatttatttttccagttttgtcagttcattgctgtccacatccgctgcatgaccgccctcattatggcttgctgatccgttctcgaaccaccatgccacacctgcggccaacacaacaactgctactacaactacgataatgactttttctaacatgaaattttcctcctgaactctttgaaaatggtcgcttatttcaaagagtcagaagctttttccccatcctgccagtgtatgtatgccatgatccacgcatggctgcgcacaaatatgttttcgatacggcaggatgccagataaatccgggtagcattcccggcaaatccgcttgcaagtcctgcccacaaaatgacgttgcgttctgcattcagccgcgtgatccgtgcactgacggtcagacgcgcctgttcggactgtgtcagttcggaacgtccgaggatatcaaggaaggaaccctgctgccgctccatcgtatgtaccgcaagatgatccggctccgcctgcgtgatatcgtacatattttgcacactatagctctgctgcaccgcaaaaaaacatatgacaaccgccaaaaagatgcctacacacctcatccggcttttttgtatccgcatgattccctcctttcccggacatgcccgtgttatgtaatcattccatcactactttgtcagtccagccttcttgcgaagcaggtgatacagccacctgccctcgtcactcagctcacttttcttaaaaccgctgacttttgaacaactgcttttaataatcgaagaagattcctgtttgtttgacagattccacgcaatgtagctgacaccgtattcatccatcgtctgtacccagcggtttgcttcttctttgtcaatcgctccgtttccggaagcatcacagattccatattccgtgacaaataccggaagtcctttgttgatggctgcggtcattttattgcgcagatctgttttgtgtgtggctgcataaaaatgcagcgcatacatgatattgtcccccttgatcggatcggctgctgcctgatccacatcctgtgaccaggtcggcgttcctacaacgatcaccgcctttttgtcatttttgcgaatggtggaaatgacactcctggcataggatttgatctctttccagcttgtaccgttattcggctcgttgcagatctcataaatcacattgttgtaacccttaaattccctggacatttccctgaaaaaggcctttgcttctttcttatgggaatttggatttccgtcgcttaaaatatgccagtccacgatcacatacattttatgtttctttgccagcctgactccttttttgatccgtttctttaagtcactgcggttctttgcatctccgctgcagtatccgttatactcttcggtatacatcgccaggcgcacgacatttgctccccattgatcatgcagctgggcaaaacacttgtcattgacgtactgcggataccagctcagtccatgtgtgctgaccccgcgaagctgtacttcatgcccctttttgtccacaagttttgttcctttgacgtgcagcctgcctgccgatgcgtcataatacgttgttgtttttgcctctgctatttgcagtccccctgtcaaacacaatcccagtgcaagcacacagaccagtgcaaacccacgcaggatttttatttttttattaaaaaaatacatgttccactccacccttctccgacggaaacaggcggctccacgttccattggaccgctgtaacattcttaatcaatcgctgtaaccttgtaatctttctcttctaccgttttctttaatacatcatctgccacttccgtggatgaggtcacaacggcagtgccagcctcatggctgacttctgcggatgttacttccggaagtgcctcaagtgctttctttacggttgcctcacagtgtccacacatcattccttcaatatgcattgtctttgtcatttttgtttcctcactttcgcttattttcatttctgccggttttgctgccggtacagcctttttatttgcttttccatgtacggaaaacaggttcagccgcaatgcgttggtcacgacacaaaagctcgataaactcatggctgccgcgccaaacatcggatttaatttccatccaaatacaggataccacactccggccgcaagtggaatccctattacattataaaagaatgcccagaacagattttcgtggatattccgaagcgttgcgcggcttaaacggattgccgccgggacatcccgcagacggctttttaccagaacaacggatgccgcatcaatggccacatcggttccggcgccgatggcgattccggtgtctgcacgcgtcagtgccggggcatcgttgattccgtctccgaccatggctactttgccctgttccttcagcttacggatctctgcctctttgccttccggcagtacaccggctatgacttcgtccactcctgcctgtgcaccgatggcttttgctgtgcgctcgttgtccccggtcagcataatgactcggattcccatctcacgcagcttagctaccgcctgcggactgtcctctttaatcgtgtctgctacggcaaccagaccggcacaggtatgattccttgcaaaaagcaacggtgtttttccctcttctgccagtttctttgcctgttctgtcatggccgcgtccacgcttaccttctgctgcatataagaaacacttccacccagcagcagatcttctccgcgcaccgcggaaagtccgttgcccggcaatgcctgaaaatcgtgcactgcagtattggaaataccgcttgtctttgcgtgctccataaccgcctttgccagcggatgttcactggagctctccagatccgcagcaagctgcatcagctcccgctccgtatattcctttgcagggagaatatccgtcacacgcggtttcccggttgtgattgtaccggtcttgtccaatgccacgatctgcgtttttcctgcattctccagtgccacggcatttttgaaaaggattccgtttttggctcccatgccgtttccgaccatgatcgctacaggtgttgcaagtcccagcgcacacggacagctgataacgagcacggaaatcccgcgcgccagagcaaaaccgatatcttttccggcaagcagccagacgatgacggtgatccctgcaatggtgatgaccgttggtacaaacacaccagatactttatcggcgatttttgcaatcggcgccttggtggctgccgcatccgacaccattttgatgatctgggaaagcgtggtgtcttctcccacgcgggttgcctcacaacgcaggaaccctgactggttcgtcgttgccgcgctgacggaggagcctttctgtttgtcgaccggaatactttctccggtgagtgctgcctcgttgaccgcactgcttccctctaggacaatcccatcgaccggaatgttttctcccggacgcacgacaaaggtatccccctgccgcacttcggtgatcgacacgataacttccttcccatcccgcactacagtcgcagtcttcggtgccagccgcatcaggctctttaaggcatcggtcgtctttcctttggcgtgggattcaagcatttttccgacggtgatgagtgtcaggatcatggcagcggactcaaaataaaattcatgcatatatcccatgaccgcgtccatatcgccgcgcacctgtgctccagtcatagcaaacagagcataggtactgtagccaaacgatgccccggcaccgagtgccaccagcgtatccatatttggtgcaccgtgaagcaggctggtaaatccgcttacaaagaatttctggttgatcaccatgatgataatggtcagaagcatctgtaagagtcccattgccacatgattgtctttcatggcagccggtaccggccagccccacatcatatgtcccatggaaaaatacatcagtaccacaagaaaaatgaccgatgcgatcagacgcttgcgcagtttgggtgtctcatggtcctttaatgcttcttcctcctgcgcaggtgtttgttctttttttgcgcctttgggtgctgcgccgtatccggctgcaaccactgcatttacgatttcctgatcggttgccgtgccctccacacccatagagttggtcagcagactgacagagcaggaagtcacacccggcactttggagacggctttttccacgcgggcggagcatgccgcacagctcatgccggtcacttcatattgcttcatagttgcctcctacatttcttacttcattaatttttgtaacatcgttactaattcgtctactttatcgtcctcgccgtttcggatgccatctgcgacgcaggtacggatatgttgtgccagcaggactttattaaaactgttgagtgccgcattggcagccgctacctgtgtgatgatatccgggcagtaacagtctttttctaccatgcctttgatgccgcggatctgtccttcaatgcggctcaggcgattgatcatatctttccgttccttctcggaacgctcttttttcttacagcattcacaagtatgttctttttccattcggattatgtctcctctctctccgataccctgtatgggtatccttctgcatcgcattatataccccctgtgggtattatgcaagaattatttttctcaataaaaatgagtgtcttccggtttttggaaaacactcatgtattatttattattcctctatggatacaaaaggaaattcttttgtgagatttcgatccatctccatcatatgcagaagacggcttgctgcacctgacggatgattgattccagattcccatgcctccacagtcttacaggaaacaccaagataacttgcaaatgtcttttgcgacattccggtttcgttacgaatcttctttacttcgctggcattgtattccttaacaggaacaactgtcacgacacggcgcggaagttttttttctttactttttgcatcctcaatggcttcctgtaatccagccacaatactttcatatacatcgctcatattatttcttctcctataacttcaatttcaattgttcaattaaacttttgataccattacgttcagcttgcgacagattttctttttcatttttagaatacacggtaatcaaataaataacctcttgaaccacaaaatccacatagcaaacacgggcactgccacttttcccttcatttgcaaaaggaattctgatctttcgaagtcctcctgttccctttattaccggatgtaaatcagaattttccagcaattctaattccagctttcttaaatcttcatccttaaacccaagtttatcccaattcctggaaaattcgcgtgtctgtataaatgttctgaccatcttttctcctttacattaccctattcaatagtagtatgtcaagttatcatgtaacccttcattctgttttttaaatttcatggagtcgtgggagaatcccccgtgatttgttcctgttgacatttactaatataatattcagaaacaatataactttatgaaataacattatcaaacacgtttttacctgtcaagaacaatttctattattttctccaaaagtgtggtatgctctgtcatagattatatttaaatgaggaagaaaacattgaaaaaattagtacaaagattattattcggaatcggcatcctatcccttggcatcacgttcaccggttgtcatgccagccattcacagacggattcacagaaaactatttccagacagacagaaccgcaggccggaccagcacaaacggaaacttcttccacgctttctctgattgacgcttccggcatgacattagaaagccgcatccacacaccggacggttacacaagaaccaaagaagccgacggaagtcttgcagagtttttgcgaaactatgccatggagcctgatcaaagtcccgttctattatatgacggcagtaaaaaacgcaatcaaaaggctcatgttgccgtatttgatctcccacttgaacatgaggatctccagcaatgcgcggattccgccatccgggtatatgcagaatatttttggagtacaaagcaatacgatcgcattgcttttcattttacgaatggatttgacgcccagtatacgaagtgggcagacggttaccgtatccgtgtaaacggaaataatgtaagctggatcaaaagtgcacagccggacacttcctacgacagtttgaaagactatctgcgtatcgttttttcttatgccggtaccgcctccatggataccgaagcacagccgatcccgctatctgatctgcaggtgggagatgtgtttttaaaaggcggaaatccggggcatgttgtgatggtcgttgatctgtgcgaaaatgcagacggcaaaaaagccttcctgcttgcacagggatatatgccggcacaacaatttcatgtattaaaaaatccggcgcacgaagatgacccatggtattatgaagatgaagtcacctatccgtttcacacgccggaatataccttccagaagggaagcttaaaacgattaaattatgggattacccacactgctcctgaataagcctgtggatttcctctgtgtctttatccagtgccacttccagttccccatacagcagattctctgccagtttaaaataacgcccatccaccgccgtaacttttctgccctgccggacacgctcttctttccggtcgcagatcagtttgatgatccccaccagacgctccggatcattgctggtgatagtacagttttttagaatctgtatctgaaaaatccagatgcaccagatcctttacctcacatactccgtttgcagctttgacaataaattctcctatctgatacaagataattcccccttttccctgtatttctattgtaccacaaggaaaagagggcattcaaaggtcgaattcaacgaaaatttctcattatgaggttggggacgttgcacaatttttcaaaatctgtctcacttttgaagctgctgcaacacgggctttctttcccttatcgatctgcgtaagtacctctgaccacgcatcatacaaccgatctaagtcaccattctttgcatttttccactgtgtttcatcggactgtaaattttccagatacccttcaaactcagacaccatctgttgaagatcatgttccttccatgatgccccataacttgttgttatatacgcgtttacagcctcacggcaatacccaaacgccaccccgatcctaaaatctttttcgtccggctcacatgtttgtaaatataaaatctcctcctgtatgtgtcccagaataccctgaaacatctgatcctctgtcgtttggttccatacaatctgggcgtctttgttccgtatcaccctgtactgataaacatttgctgatacggatactatgcataccgcaattgtgattaccaacgcaatttttttcttcatcttatccctcccaccaaatgaaaatcttccattttgatatgcccttgctatcacataggatggttcataaaatgcactacaattataattatcatatttcctcttccagtgcatagtcttttatccagtcatcttctacttttagcggattttcacaaaatctggtaatactgtagcatttttcaaacagaaaatcaatcgttttcctcaccttggttgtttttggacggtaactataaattttcatgttctactatgaatagtacccacaatttcacgtaaaatcaatgtaaatgatttataatgttgaactcaaacgtacattccgggtcactacagtggtattttggcttaaaatgggcaatcttaagaaattacgagaaaagaaaaaactttcacaaggtcaattatcaatcagatccggtgtaaaccttcaaacgataaaggcgtacgaacagcgtactcgcaacatcaatcatgcacagggagatattttgaaccgactggcaaatgctttggattgtgcaattgaggatctgttagaagatgatcctgcttcgagggcataagaaaaggaccacctcatcactgagatggtccttaaataggcaattatacatttacgtgtttagaagaaacaaaacgtttctttccagcttcaaactgttctgggtacattcgctgtaccacggattcatccacatttgcaacaagcatgttatacactgcttcaatattgctttcattcctgctttcattcctgatccgttttgcttcataatcaagtatttctccacccataacagaatcaactccttccttcacgttatcgtatttattggttaatgattgtgctaccttgtcacacattgctttgattgcagatttttcaaattccgatattttgccttgttgaaccaacgattccaactgatcccacaacttaagatatgtatttttcatatcttcaatcaacgcatgatctttttccattttttcaagtgagtaattgaaaaaataaaacggaattaagaaaaacaacttcttactaagcatatcatccaaactgtaatctttgatctttacaattggaattttatagcttacagttcctccaggtgtatttaccacaatttcatgggaatctggtgtactatcattgcatcttaaatataaaattccagatgcaggcattgtgaataccgtttttgaaacatctgattctgcagtagtaattgcaatctgcgtcgaatactcaaaaatccgtaccgtcattgtgccgtctacgctactttgacattcaatgtgataccgtcttgagttaccgattgtaaaatttgaatctgtgattcgcttttcatcggctcctgttgtgataaacacttcattctgatacagttccacattctctgtttcctgccaattttctccaaacatttcgtttaccaatgggacaatcaatcgtttacagtccgtcagtaatgtgcgaaatgagtcatcataaggtgttccataattgctcatatcttagatatcctctctttccctacttaagtagaattataattttatctatataaacagggaaagtttgggcatccctgattgttttcagggaatatcccttattcatttagtctttatcagactttgttgtatatgcagccacgagcatctgccgagactacatttcttgtactataatacttttactttacacatatattatagcatatgccgtgaaatctgcaatatacattcaccggcattcagacttcaagaccgtatcggtatctacagactctttttcctcgactcaaacttaatacatattcattataaggcagaacgcgtgttcttgcaagaaaaatccttttcaacttctccattcgtttactctattgataatagtatgaactggttttttgtcgcatttcgacttctcaaggtaaatgcaaatttttaatcctttttgcatttactttgagaataagtcctaacatcattagatgccatgagctttgcccttgatttaagcggcaattttgaattttgttcataataaaacaggcacaaagtagagccaaaaaacctattttatgcctgtcatactaaatgcaaacctattttgcattaggtttgcaaattaacctttttttcataaacattacctcttttatgtgcaattatttaacattaattccgcagtgtcgtaaatctacaaccgacacgttcttaactttaaacgtatatttatgaataccttttttaattactttatttgccggggatctgtactgataaatcagtttacccggacaggaagcataggtataaaacggataagccagatctgctcccatcgtatttacagtatatccctttacaataatggtatttccactgtaggaaagagattgggttacaaacttgatttcatcttcttcatagtcgctcagcttggtgctgaccttcaaggaatatgtatttgcctttggagacactgccttactcgtctttgcatcatttttgttttcgatcatttcgactttcgccttatattttgccgaacctgctccttttgccttataagtaaatgtgtatttacttgtggcagcacttgtaaaagtcttgatcttttttgagcctttataaacataaattttggaaacaccacggactcctgcaccgccattattgacatccacctgaatgccagcctgatccgcagacatcttcgtcacttcaatcttcggctctttttttacgactgttttatacaccggttcatccgtaacggtgatttttgctctaaccttaaggcgtggcagcgttttcacattcttgttttcttcttttatatagccatactgtacggatacctcttcgccaggctttgcggtctgtcctgtaataacggctgattcactccgattgatcgtctgactcattagtgccggtccaaaatcagcaaaccaggttagtgtaaccgggctttccgtagtcacatacatacctacccggataactttatccgtgtcattttttacaacaaatgtatccggtttctgtccgatataaatgtatccggtagtatttgcttcaccaaatattacactgccactttttgcttctgtaagtgtgtaagttaccttatttgcatccagatccatttcgaagttctttgcaaaaacaggctctgcatgacagattaccatgaccagcataagcatacatgctgctatccccaaatgcagtaaccttcttccttccatttgtgtttccttaaattgtttgaccataaccagtcctcctttttcgtgcatttactttaaaattatttatatgcatagtagataaattttgcaagttccacgcgcgtaacagcatcgtccggtctgaatttatgatcaccattgtctttgatgatgcccttggactcggcccatgctaccgcatccgcataaaatacccagtccttgtagtccgtaaatgttgatttctgggatgctttcggtgcaccgatgctctgccatacataatacagtgcatagccacgctggtaagcatattttccttcaaagattccatactcaatcagtcccttatccactgcccacaatgcagctttatagtaactgtccgtgctcttgacatccgggaaatgatttaatgctttcggtgtcggagatccgtttgccttgtacaaagcgttaaatacatcacccttggtgcagattgccttggaataaaattcgttcttgctggtaggctccatgatcttgttttttaccacccatgcaactgccttggcatcggcagcatccacatcggtgtacgaggatgtggaagatgcatttttaatcttgatcttcacggtctttgtcgcattcagattgatcgtatagccgccctttacttttttcatataggttgtatcaagtggcagatacgatttcacacctgcctgatccgtacagatcagatattcgccagccattgcctcctcatctgcaaaagttgtctttccggtgcttgttgtgtaggacttgatcttcttattggaagatgcaaagatctgcaccgcctctgtctcataagttccaacgcccagatactgataattttcccgtaaaatgtttgccttatgactggcactgttcatccatccacgcatcgcaagctgtgccgtaaccgtttttgtacatttgtacatattctcgccgagtccggtagtcttaaaggaagacggaacggcagtcttgtagctggttccattaggtctggtatgtgctagctgtgtattgttgacattttcctttgcacggactgcggttgctttttgcaatgctgccggcatggtaagaagttttttcccttcctttgcacgctcaatattggtcaaccgcaaaatgttccattcatcctcagaaacggcaattcctttttccggccggttgtttcccaatgtcggaatcacttcattgatataaagttcccttgtctttccatccagtgacagattcagataggcggtaacacctcccttgctttcataagttgcatctactttgcggaacgatttccattctgctttggttccgttttttgctgcagcagtaattactttcatgacctgtgctttggttgttgtattggtcatattcattttgccggctgctgaactcattgccccccagtcttcctcgagtttttcctctgtcgtacccacattgtctgcttttacggtcatctgcggtatgatgcagatcatcataataagtaccagtgccagactgcacaaattttttcctatttgcaggattatttttttctttgctttcatatagatttctcctatacttctttgttgttctttaagatcagccttttatgtttgtttgagtatgtccagtatttggaagaaagcttcgagcagtttccgaatgtgatcgaagaaactttcttcgcctttgactgatatggtacccagcttgtatactcgcgtccactcttctttccggaaccggtataataattatccgatacggtattttcccctgatacataaccggcgatctcaccagccatggcatattttccttttgccgtaacttttcctacgttgtaattgcagcttccgtcgcggaattctccgacaacaccacctgcataaccttttccggtaaggctgaccgttcctgtattataacagtttttaatcttcgttccacagtaacttacaccgccaacattggtaaatccgtttttcgtattgacggtaatctttccggtattgtaacattcgctcattgacgctgcaaatcctacacccgcaacttcattatctccttcatagtctcttccggagcagacaccggtaaaggaaaccgcccccttgttatagcactgtttaatttttacagcggacgcttcgataccacacactttgactactgcgcgcgaggtctttcctccctgatttgtcacagaaattttaccggtattgccacatcccttagcctgtccataacacgagccggcaacaccgcaagcctcaaattcaagcccgaatcctgcatatccctttgctgtattcttaattgtaagatttccggtattgacacacttttctattttcttcgtgatcatggcaataccatataccgaaaacgaagtatcctcattccgtgctcctgtcaatgtgatattgccctgattccggcaattcctgaaattggaattttcatctccccaggagattccggcaaaaaaacctggcagcgcatccgttactttaatatctgcattgactttactggtacaatcggtaaaatcacaggattgtgcgctatcgacaattccggcaccaccgattgtcgtttttccggatactgtgatattggaaaacctgcacttttccgcctgatataccagggctgctcccatttcttttccctgaatcgtcacatttgtcataacaatgtttttaaacgttgcattttttgcattgttgaacagtcccattcccgtatagttcttaatcgtatgtccttttccatccagggaacccgtaaagcactcctcgtgctgcaccttcatatcataatcataataattcggaaacagattcagattccccttaattgtgatatccttcgccagataataatttcccttcgggttattctgcatggcgatcagatcctgctcggaattgatctcggtctcctgtgccgcgtatacggtctctgttcctgtctgtacatgcagattagtcggaacattggtacaggccaatgccagtgccatcacaaaagctgtcatttttttcataagcatttcctccgttgtgtccatttttcagacttctggcacatctggtctgatgtgcattcgcttcgggaatatagtaccacattttaaaaaagatctgctgttaattgcgcgaattacagttatttcgacatgaacgattataaaatgccgtcatttgcggttcatagttatgaaaaaaaggggaacacctctgctttgtgcagggtgttcccctttttctctataacagccacttcatctccgcaaaaaattcccgcagcatattgttcggcagatattttggtgtggaatccgccgcaattccacagacatcggaaagtccgtacttttttgcaatctgtaaggcacggaatacatgaaaattgttggtcacaatgccaacggatgcgccttctttcatcagcattttactgttcgtgatattctgctcggttgtctgcgattgatcctctgtcaaaatccgcgcagtatcaatgcctttttcctgcagatactgtgccattccttctgcttcggtccacggctcgttgcttccctgtcctccggaaacaatgcagaccgtgtccgggttttcattcagatattccacagccttatccagacgatatttaagaactggactcggaccatcctttctcacctgtgcgccaagtacgataatatagtcgagcccccctcgtccatccgcgtgcatctggctgatcacacagccctctacgatacaaaacacaagcagtccgatacagacaatcattcctgcaaagatttttatcggatgcggcacctttttccacacttccatgtacacggaaattccaaacagaaacaccacgatcccgataccaatccatataaggaaaaaagctgtgccggaaccggtcgcatgaaccattaccgcataaatcacactcaggattccaagcagtaaacatctccaaaataccatcatattctttttcatttctccatcccttttccctccgctaataccggatatgaaagccattttcctgttcatccggtggtatgttttgccgatccatcccggtaatatcaatatatctgtcctgtttcaactgctggatcatctgatcaatctctccgacaagcccctgtagttcggcactgaccgatccatcatattcatttcttacccatccggtcacaccatagtactgggccagatgcgacagacggtagcgaaaccctaccccctgcacatatccagtgaaacagatgtgttctcttcgtttactgtctgacataatttcccctaacgataactctgatacaatttttcaaatgccaaaaacgaccgctcaatcatatcgtaatcgacacagtaggacacacgcgcataccccggacagccgaatccggtcgcggatacaatcagaagatcctgatccttggcacgctcgcagaatgcatctgcatccggctccaaagccttgacaaacatgtaaaacgcaccctgcggcttaaaacattcatagccgatctttgtcaggccatcgtagagcagatcgcggtttttcttatataattcaatatccccagtgttgccgacacaggatgcaatcactttctggaacatgctcggtgcacagacataacccagcgcacgcccggctcctgcaattgccgcatagaccgtcttactctcggtcacttcatccggaacgatcacatagccgatacgttcacccggcagcgacagggatttgctgtaggaatagcataccagtgtgtttgcataatattttgtcacatacggtacttccacgccatcgtatgcgatctcgcggtacggttcgtccgcaagaataaagatcggtgtgccgttttcttcggatttctttgtcagaagtgcggcaagtttccggattgtctctttcgaatagacagctccggacgggttgttcggggagttgatgatcacgcctttagtgtgtgcgctgatcgctttttccagggcttcaaaatcgatctggaaatcgctggtgtgcggcggtaccacaacaagctttgcaccgttggattccacaaacacgcggtactccgggaaaaacggtgcgatcgtgatgaattcatcttccggtgaagtggtaagtgcacggaaacatacggacaaagatgcggcagctcccatggtcaggtaaaaattgtctgccgaaaacgcagtctcatatgtcttgttcaggtaatctgcgattgcctgtctcgtctcgatatctccctgtgcagaagtatatccgtgtaaggaaatggaatcgagtttgtgtgtcaggtcacggatggtctcattgacgcagtccggtgccggtacggttgggtttccgagggaaaaatcatagacattttccgctcccacaactgctgcgcgctgcttgccatactcaaataattcacggattgccgaacgctggcttcctaattgatacatatcttctgctacgaacattttattttcctcctcatataatcaggtgtctttattaaacttcaaggcttttcaaccttttgtatctcccgtttttcaagttatttttacagataatttcttttttgtattttaaaatgatattatatgtagattcttcaaacttatcgtttctggcttgcaaggtaattttcatactccagccggctcaaccgctcgatttcctctcgaagattgtccgccgacatgcgaagcgccccctgactcatgaccgtaagctgctccagcccgtcatttgtcgcaaccgtgacacggtacttgtgcccgatctcatgcacggtgcgctcgataaatgcatccgcggtctcatcggttttcgtgtagaccacatccagattgtgatatttgcttttggcacccggatgttccttgcgcttataggcatcaaacaccaccagcaccggacagctcttgtatccctgataattgcttaaaatatccaaaagcttgtcccttgcggaatcaatattgacacgggaaagttcgtttaagtctttccatgcaaaaataatattgtaaccgtccacaatcagatattcttcctgcggtcccttcgccggatagatcggattgccttttttatcatattttaccacattcggcttcggcgcatcggatttctttttcagccacttgcgccgctcctgatcttccatatcttcgcggctcatgccaaactcgcgggcataaatctgctgcagctcctgatctaactcccagccggtcttgccggaagactgctgccggtgcaccgggccaaaactctgcccgttggtctcataactgcgcccgtccgcaggtgtctgggtttcctcctccggcacaaactgccgcggcagatgcatataatcatccacctgatcccacggcacgataaatccggcaccgtgcgcacagaataccgatccggttggatttgccgtatccgcttcactgtcatacccaattcccgtgatcacttcctcactgttgtgacagacatcatagccggaaagttccagtgtaagatgcccgagtccgcgggtatacgcatgcacctcactgctgtagtcctgcattgttgcgaccggaaccgtgccctgcagcacggcgtagtccatgccgtttccggtgccgaattccggcgaatcaaacttgcctgcacgctgctttaaatcggtcatggcacgaccgaccatctcctgcggcacttcaagcgtaaacgcatacactggttctaacagcacgctttccgtactctttaacccctgccggatcgcgcggtaagttgcctgccggaaatcaccgccctcggtgtgtttgatatgggcgcgtccgcttaaaatcgtgatttttacatcggtgagtgctgatccggtcagtacgcccggatgttccctctccataatatgtgttgcgatcagccgctgccagttgaggtcgagcacatcctcactgcacacgctcgccacctcgattccgctgcccggttcgcccggctccagcagcagatgcacttccgcatagtgacgcagtggctcaaaatgtcccacaccctccaccggctttgcgatcgtctccttatatacaatgttgccctgtccaaagacaaccacaacaccaaagcgctctttgatcaactgcgtcagaacttcgatctgcacctgtcccatcatctgcgcatggatttcctgcagttgctcattccagaggatatgaagctgtggatcttcctcctcaagctgctttaatttttccatcatctccacggcattcacttcgtccggcagataaatccggtagttaagcaccggctcgagtaccggcacactgctctcctgctgcgcgccgagtccctgtcccggtacggttgtagtaagtccggtcacagcacagacttccccggcctccaccgcctccgcggtctcaaatttttctccggaatacaggcggatctggtcgactttttcctccagaccatcataggaaatccggtctttgacatgcagcgtgcctccggtcactttcagataggtcagccgcgctccttttgcatctctgccgatcttgtatacacgggcagaaaattcgtcttcatactccggtgccctgtggtattttgcaaagcctgcaagcagttctttcacaccctccactttgagtgccgagccatagtaacacggaaacagttcgcggtttgccaccgcatgcgccagatactcctctgcaatgctgccctgctccatatactcatccagaagtgcttcgcttcccatcgcagcttcctcgaaaaatgcttctccgctgtctttcgtaaaatccacacatccatcggacagttcggtttttaactgctgctgcacgacttccttgtccgcccccggcagatccatcttgttgacaaataaaaaggtcggaatgttatagtgccgcaggagccgccagagtgtccgcgtgtgtccctgcacgccatcggttccgctgataacaaggattgcataatcgagcacctgtaacgtgcgctccatctccgcggaaaaatccacatgccccggcgtatccagaattgtcagacctattgtctgttcgctatgcgaactttcattcgtcatttgcagccgaagtcgcgcctgcttggaaaaaatggtaattccacgcgcccgctcctgcgcatctgtatccaaaaatgcatcctgatgatccacacgccccagcgcacggatctgcccggtagcatataacagcgcctccgacaatgtggtctttccggcatcgacatgcgccagcagaccgatatttatattttttgcgggattttttctacccataaaaaaagcccctttccatgtatcataatccaatagatttatgatagcacagaaagggggagaagtcacgaatcttacacggtcgtattcactccattaatcgtggcgtgctcatcctcgcccatcggaatcaccagacatttctgcccgttgatcacctgcgacttgatctgcgatgccttctccggcttcacacgcagtaccacatcataggtctttgtctccgcgatataattatcgatttcttcctgcttttcaatgagctgggacgtgcgctccgcaagcgcctcatccttttcattaagctgcaccgtcagtgtgccgacctgatcctcaagtgccattttttccacacgcagttcgttctgcacaagcgccttggagtcgatcacattctcggctgcaggcggtttctcgccaaatgcctcatccacggacttttcgatctttgcagccttttcctcgctgatctcactgtctgcgagaagctttgtgaccacttccttatcgagcaggaaaacatcttcgtcatcgtcgtgtgtctcggcatattcatcgatcatatcacttaaattctgttgcagatccaaaagcacatcatccgtgtgctcatcctctgcgccaagcacgttgcggacgatggaatggaatgccatcttctgctcggttgcagtgcgctcaatgccgcaacccagtccgtttgccataaattcagaatgtggctccttggtatttttcgtgtaaaacaatgtcgaatggatatccgtactgcggtcattgaatgccgggaataaaaatgcagtgtccacggctcctaccacccagtcgcgcacacgcggcccgatccggtgctcatcctcgagaaagccaagccccggctttgacagatcgaccggacagatcgcacagatcagatattcatacacttcctctgactcatcgagattgttgttgtcttttgtgcgtgtcattacatcatatgcgtcatgaaacaatacaatcagataatttccggcatggtcatatgtgtcgattaccagatcataaaaggtatccagcagattttcatcttccagcttcgatgcgcgcagtgccatcagaatatgctgacgaccgcccacttcctcttcctcaatcggaaacttcaattccagaaggttatttccgatggttccggacaatgccttatttgcaatttccagatatttgtaaaattcatcttcttccagattcagaaatgtatttccaaacttacagactttattgtgatttccgtcaacgtaacagccacacacgcgcgtaaacgttgccgcctctttcttgaatcttctctttaactccaggacttcctttttattcatttcttggattcctcttccctgattttctctttcagttcctcaaacaatgaaagaaactctttctccacatcagccatcggctgaaattcatagctcggtgtgctcaccataaccggctccaccgaatacattttttcatccataaaatgaaggaactcataatacaggcagctgtcatcaatgtttgtaatcagttctgcctcttccccctccggcacatatcccagaaatttagtgtagatcatatgctgcagctgttcttcgatctgcagatacatcgtcatgtttttcttgaccggacgggtaatgtccgccagataggcttcacttccatcgtgaagcagacaggcaagtgccgtctgcggcagatagtttctcgcagttgcctcatggcagcactggatgcagtgctgacctacagaaaaaaactgcggaaaatgcccgtttgcccgcgtcatcatcgacagggcatgtgcaatatcctcaattcgtattttatcctcttccggctcaaaggtattaaagtcaacctttgaaaatgttgtcagacaatcctttttcatctgtactcccccatattacacgcatacgtgaaccctttaccagctaagtacttcatgaccatcctcagtgacgagcaccatgatctcccactgtgcagatggcattccatcctcggtgtatacttcccagtcgttctcttcgtcaatgaaaatctccacaccgcccatgttaaccatcggctcgatggtaaagatcatacccggtgcaagtaccatctgggttccgcgcctggaattgtaaccaacccacggctcctcatgaaattccaggccaacaccgtggccgccaatttcacgtacaacggtatacccgttagcataagcatgatcgtgaactgcctgacccatatcacccaaaaaaccccagggctttacttccttaagtccaagttctacacattctttcgttacctgaaccagtttctttttctccgggcttacttccccaatgcagaacatccgggaagaatcggaaaaatatccgttcagaatggtagaacagtctacattgataatatccccctcttttaagatcaccttctcggaaggaaatccgtgacatacctgctcattcactgaagtacatacactgtatggatatccttcgtagttgagcggtgccggaatacctcccatggaagtggtcatatcatagacaatcttatcaatttccgctgtattcattcctgcgtgaatgttcttttctatgtaatcaagtactgctacattgattttggcactctcctttatccctgcaatctgatccggcgtcttgatcaggtcatgtgtcggaacaacgtgaccctcctgtgccagacgtgcaagtttatcatcgaaagccgcatgacacgccttatatttcttgccgcttccgcaccaacatggatcatttcttcctaattttactgacattttttaatcttctttctttttattattgtatgtgacatttccaaagctcacacgattccatactttagcattcactttgtatttttgctttttcaaaagcttctgataggaatcctccatatacgcataatcgtcataggtacggttatgcagctgtgcatacacctcctgatatttctgggcgtatgcaatcctttggatcgtcttttttgcatcttttctggaaatccccagtgccgtttccccctgacgctccgttaggtcctcccagaaatcctccagtttattgtccatatgcttttggtcatcgtcatccagtgtaatgccttccttcatggccatctgataaaaaagttcatcatgaagtgccatctgcatcgcgtttttgcgtgcaacggcattcataaatcccccttctacgcgcataccccagtaacggttcggatcatccggatcatataccagtgcctcctgctgaatctgatattcctcatatccgacataaaatgccatgtctctgagggtcagtttttcaccattgatctgcgctgccacttcatccagagactcccggtacacaagcggccttgcattcgtcatgctattattatttctcatgagcatcacaagcacaactgcaatcagaacaatggataccagatgttttggtctcatcaaaaactcctataccaatctgcggattgcggtaattgtatgacagttcaccggacggctgtttgtaattccggctcttgttgactgcgcctccacgatatttccgtttccaatgtaaattgccacatgtcccggatataccacgacatctcccgcctggatattctggtaagacaccggctgtcccacactcttaaatgcctgggaataccgtggggtactgattccaaaatgtgcatagacctgatgtacaaatccggaacagtcaaccccattggtcagactgtttcctccccatacatatgggtttccgacaaactgctgcgcataagccacaatatccgcaccgcccacatttgttgtctgtgaaggattgcaatccggatctttcaaataggaatcgcttgcaattccaccactggcaccggtacctccaccgtcataggtgttggcattggcacgcgctgccgcagcctcctgtgcacggataattgcctcctgtttggaaattgtctttttatagtcctgcgcctgcttctgtgcttctgccagctgctgcgcataggcatctttttgtttttcaagcttcgccatgagggttttcagttccccctgctgggtctgatacttgtcctgcaaagcaagcagactgtccatctcatctgccagctgcatagtccagtcctcaaccttctttaccgcattctgataagaagtcataagttccctgtcagatttgtacagatcggtcgcatattcaatacggtttaacatatcggagagcccattggactccagaatggccgaccagatggaattatcggtactgttctcatacagatactgaatcctaagcttcatggcatcatactgcttctgctcttcttcctttgcttcttccagctttttgtttgcctgctccacttcattctgcttgtccttaatatccgacttcagctgttcctgcttggaaagaagtgttttcatcttggctgcggcaacagagatgctgtcttttacatccgactgactgtctttgatatttgcaatgtcgctatttttttctctcagctttttcttgtacgcatcacgtttcttttcggcctcggtctttgcatacacattcggcaccgcacacgcacctgcggtaagtgaccctgccagaacaaacaccaatactgccgcacaaatcttattcttcgtttttacatgtattttcttatgcatattatgcctccagacttatcttccatgggagcactcccatacctccctttattgtggcacaaaatacatattttttctactggtttttcttactaattaaggaaaaattcataatttttttcaaaaacagccattatttccgcaaatcggcattattcattaaccagaccgtactcagttttccatcttccccatattgtgcctgcaggctggtataatatccctcgtcttcaaaataccactcataggacgtataattgctcatgctcacataatttgtcagttgatatcccaatacctgtccaaaatcatccggctgactctcaaaccccagatcccctaccagtttcagatcattttttcccaccggtgaacccggatttaatgtaagtcctccaacgattcccttttccggcacaatatccttatccgatgtattaaaaataaaaatcgtcccgcggtaagttccatcctcctcatagtatgcataaccattggattctcccggcttaatctttttatcttcatcgttactgatggtaaatccggctttttcaaactccgaaaatttacacggaatcgaaaactcgtttccggaaagggcgaatgtatgaaatccatgcacataagacacattctccccattcagattcttaaattttccatccggcgtcttactttttgaatctgcctcagcatctttgtgggaattttcagaggtatgggaactgtcatcgtcccgaatcgtctgaattgcctcacgaatcagacccacagccccgttgtcggactttaaatacattcccacgattccgaagattgcaaccacacccagaacaatcacaacaattgcgatggcctttttgactcccgaattgtccttgaccggatttccctgcgcatcaacctcactttctccctgctcccgtttcgcccggcagtgtattttttcgcgctccgcgcgctcgtattcccgctggctccagctcttcttgggctgatcatccagccgctgtccatcacgcgaataatacaccccgtttaagttgtatccccccgatggtttctgctccggtggtgcatagtcctgaaatttcttttttctttcgttttccataactttctccttttgacgctttctatcatcaattctaacattcactcactttctttacaatgagtaacttatcgccctgctgcacatctgccgatttgagtccgtttgtctccataatttctgcctcggtagtatgaaaatgtcttgcaatgtcccataactgttcttcttttttaacaatatagccaacaattcccggctgcttcatcagttccaccgcgtctagcggttccttatggatatccacaattttttccatgcacacttcctgctgtacaattgtctgcagggaaataaccgccttgacctcaaatcgttcgttatccagcagattcaccgcaagctgatcaatcgccggctcgatttcataagaaatatcttccgtgtgccctttcatgccgggaacatcaacaatctgtgtaaacggaatctgttcctgcgtatgtgcaatcggaaaactgtcatccgtcgttgcatacaaaatatcaaccgtcaggattccttctacctgtaacccgttttccaccggttccacatgatccatctctgcatgcccctcaaaagaacacagctgtaagatccgttcctgttcttccgccagcttcatctgttcagagatccgcagttttgcttcatttttgatcagcagtttttttgcacagaccatttctttctgtggcacaagatttgtttccagcgaatagacatctgccagaagttccacattcctttcttcccacagcttcatttccacatccatggaaagattcaggctcagcgccctcatttcgccatcataatcttctgccggttccacctcatattctttcgtctggcaatgtacccagcagatcggctgtgttccggtcattcccccttctattgattcggaaaacggaaccatcgtttcataccactccatttttccttccggactgctgtacaatacattcacatacgcttctccctgaatctgcatctgctccccggtgcagatcacctgccggttacgcacttccacataatcataaagcagatgtccgatattcggactggactgtggcagtgcaatatcactgtgcacacgcaggatatcctttttcgcggatgtcagtgccaaaagctgcatcgtccggcttttctgctgaatatccggatcattttcaacaccacttacaatttcttcttccaccggcacctcacacacggcatgaatgccaagcagagcacgcacggcaagctttctggaattgatggcactgatattcagatcctccagatctccgctcagattgacggtatcgcgttcttccacctcatccataaaaattttttctccgaaatttatactgtccgtaaaagattccagccggttatcttcactgcggtataacacgacaaaacgcaactgtccggtaacccacaccgtctggctgctcaccttgacatcctcaaaaataacagaacccctggtatgtataatgttcaacagatccggtttgttgtcttttacaatacagtcatcatccagcgtaatctgggtaaacgccctgctccttagtaaattctgtctgaacagctgtctcttcaattccaaaacaaaaaaatcccctctctttgaagtaagtatactaatacttattcaaagaaagggaattttattcattcctaacaaagtttcattcgaatgtcctttgtaataatatcagtgtaactgaatgacaataactgtggaggattttcctctcgctcgtcatctacaagtactgtaaaaacgcttggatatgcgccctggataacgccttcctgaatatctaccttgttacgtccacggtctaactgaattttcactctgttaccgcgctgccgatgaacggatgcccgaaccttgctaatctgtgcctgttccattgttgcctcctccatttgagttgaatattctagaaaatactatatctagtagctttagtatagcagagtgttaaactttttacaatagttcttaagtaccctattgaaacagtacctcttcctcccgcagttccagcttcaatacaataaacggataactaggtgcttttgtcacctcttctccgttttccggtccctgcagtctcgtctttacacagatggcggtatcactcagataacagtcttccacggagatgctgtatcctccggtctcctgtattccataacctctggcaacgtataaatattcattatcgctgtatgtaaaacggaaatccccctcctttttttcttcaatctgttgtcttaaggcttccggaagttcttcctcctttgtcacggtaaactccagatcctttaccttctcctcacattcttttcgcacacacccgctcagcagcataagcacccccagcaaaatgatcatcaggatatactttctttttttatctttcatggttgaccactctattttcgttcttatgctatcctatgcagcggtcgtgcgatctattcttttgtatttttgtgttcctgcagcatttcatgaatcacattctgacagtatgcaccgatatgtttctgatcttccttggaaagctccgaaagaataatcggttctccatacgtcagttttacctctgtactgtgcagccacggaaaatgattttcaaaaatatctgccgtcccggtaagtgccatcggaataatcgggcatcccgtcttctgtgctattttaaaagaaccgtccttaaacggcaaaagcgtcgttgtatcctcccggtcacgatttctcgttccctccgggaaaatacagatagaaatgccggacttcacctgatcgatagcggtcagaatggtcttaagtccctgctttaaatccttgcggtcaagaaacagacaatacagacggcgcatccatattcccagcagcggaaccttattgacaccatctttggaaatatacccggtcagattcggacactgtgcataagtaatgacaatatcaaaaatgctgcggtgatttccaatataaagtacagcctgatccgttggtacatgttcttttccctcaacagtcagatgaacccccgccaaaaaagatacacagcgcagtccccactgcacaatccgaagctggctgatatcggctgcatgtttatcaaattttgcgataatccattcgattccgagaaccggcagtccaagaatcaaaaataaaaaaacataaatgactacgataattgtccgcattttcttcctccataaaaaaagcctgaagcatttcatcttcaggctttttcactttttgcttaaacctggaacgttgacagtgcatccagcaggctctgggccttggtcgtaagactctgggatgcttcatccagattcttgattgcatccagctgcgtacctgctgccgaatgtaccgatgaagaacattctgccgtctgggtggacgcatcggaaatactctcgattgcactgagtgtctcgtttcgtgcaccattcatttcctgcacattattcgaaatcgtctgcagtgcctgaatcagctgcgctacaagctggtcaatctgtttaaaggaatttgtggtatcctctacaacggaagactgggaagaaactgcatcttccgcctgtcttgcgatatttaccacttctcccgtcttggaaacgatttcatctacaatggaagaaatctgggaagaagaagcaagacactgatcggcaagctttcggatttcttctgcgaccacagaaaatcctctgccggcatctcccgcacgcgctgcctcaatggacgcattcagggaaagtaaattcgtctgttccgcaatatcattgatcgcagaaacaatgttgctgatggattttgatttttcttccagttcctgtattgactgaatgacatttcttgtaatgtttgcagtggtctcggatgtctgcgtaagtgtctgtacagaagatataccggtggtaatggtttctccggttgcagaagtaagttttcccaattcatctgcattggagcttacattattaatctttcccgataaggaatccatctgactcatacagttatcggaaccggtatccagtttgttcacaccactctcaatctcttcaactgcactctgaatattcttagaggtttcaaggaatgttccggatgcctctgccacatgaattgccgcttctccaacctgctgactcacatcattgacatccagaatcagcgatttcatatgctctacggtatcattgacaccatcacacagtaaaccaaactcatctttgtgctttgcggaaagatgaaccgtaaggtttccattggaaactttgcgcagctgacgcagaatatatttgatggttcctgtcatctgactcgaaaggaataatccaagtgcaagtgcgatgatcatacagacaatcacaagtacggttgtcagctgtttgattccggatgactgctcaagcagacggtcagaaggaatcagtgccgtaaccataagatctccggctgaaagtttactgtatacaaacatgtatgactttccattaaatgtaatcatctggtttccggaatcttttttcccgttcaatgctttcttataaaaacttgtaccgtaaatcagtgctttttccgtcttgacggattcatcggaataaaactcttttccatccgtatccgtaattaatgctacatagcctccctttccagggtccagtgactgcatggcggaacggataaaggaatcactgatgtttatgatcatcatggccggctgattgttcatttttttggcaattcgcagacagtaggaatcaattcccagatccagtactttatccgaactttcatctgccccgaagaaaaaccagtttgttgcactttcgctgaccagttttccctgatcgcatccgacatagtccgtataaacatttcggtcacgaacaattccctgacagtcaatcgtacgcttgttgtccgcgataatataggctccctgaatcttgctgtcgagtgccatcttattgcgcagtctgctctgatagtctttgcgcacggagctctcatcatacacctccatcagtcctgcaaaatacttacgcagatccgactcggtcagataggtcttaaattcgtccttctcactcgtgataaccagattgatatactgctgcatcgtatcagcagtctgctgtacagattctttgtatgtatccacaatggcattggaagcgttattgtaagaggtaataccaagaaccagcacaccaataaccggaatcaggaaagcgaccaccagccgcatcgcaatactgcgatagaacggaatttccgctttttctcttttctgttcaccagccaccttttttattttaggaatttttgtctttttttcctgccgggaagcattgtcacgtttcggtattttctttgttttttcttttttgaccttttctttctttagtttatttgttttctgctcatcgttttttctcatattgcatacgcctccgtaaattcagacgattcctccccgcctataatatagataatatactacaatctgacaaaaaactcaacttgaaactactataatttgttatactttactattttaacacagcaatactgcatgccggcatctccagtttcccatctttcagctgtaccgtctcttctttcagtgtcaggcttccctccaggttcatattttcaagtgctgttttcttcaggtcaaccgtaccgtttccttccccaagattatacacaattccgatggtactgtcctgatacgttttcgtgattgccgcctgtgaatctttacacagactttctactttttctatggttccccttgcaatttccggattctgattccgcagacgaagcgcatttttatagtaacttaagatagaatccttatcctcttcctgttcatcttctgccggaaacggagattcaattccagcatccatatctgccggtccctttgtcattcctgtggtgtcagtttttgaccacaccatcggaatacgcttattttcatcctttgttccggaactgttcatgccaatttcttccccataataaacaaacggactgccgttcattgtcatcaggagacctgctgctgtcttaatcttatccggatcattcaccaacgtattggcaatccttgccatatcgtgattggacaaaaacggtgcatcaatataatccggatttttttgggagaaatcattctgatatttcagcatggaattcacaaggcttaccggatcgccctttcttaccgcattgaccagtgccccttttgccgttcccgcatcaaaattaaacatgcttggtgttccactcgcataataatccgcaatgacattctcactcgcccacacttcggataccatataaaactgtggatttttttctttacagtatgtgtacagtttatttaaaatatcacaattcgcattggttgcattttcttcataatgcatggccgcatccatccggaaaccatccacaccaagatctatccagtaatccgcaacttcttcaaattccttctgcactgccgggcttttcaggttcagatccggcatttccgaccagaaggatccctcataccaccagctgctgcttcccggcactgcatagtaggttgttccctcctgcttgtcagaaaaatgatagtaatccacatacggacacaccgtatcgtccggtttttctcctgccttcagaccggcaagatactcacatgcctgtgtaaaccatggatgctgagaagaactgtgattcattgccacatcaatgatcagccggatacctttttcatgacacgcacttgccagctctttaaaatcatccgccgtaccatatgcctcgtccaccgcttcgtaatccgttgtatcatatttatgataggttggggaaggcatgatcggcatgagccagattccgttgcatcccagatctgagatgtaatccagcttttcttccacaccctttaaatcccccatgccgtccccatcactgtcataaaaggagccgacaaaaatttcatagtaattacggtaattatcatcaataatatttaattttgcttcctgtgtaccgtgccccgaaatacagcctgcaagcaccccggcaaaaagcaccagcacaacaactgccgacaaaattctttttttcataacctttcctttcttcatcggatgaaaaaaccggcggtcaaacgaccaccggctttctatctttcatcattaaccctttacagcgcctgtcagaccatctacatagaatttctgcataaatacgaagagaatagagatcggaatagacacaataactgcggctgcagcccatcttgtaaaccatccgtttacaaactctttctccagcatattgtacaggagaagtgataccgtccaatacttatcctttggtccaacaataacacgtacaaatacgaagtcaagccatggcgcaaggaatgcggtaaggatcgtatatacaacgattggtttactgagcggaaggatgatcttgtaaaatacctggaactgattacatccatccagaatcgctgcctctgacagagactttggtaccgtatcaaagaatccctttgcgatataaaatccaacaccagatcctgcagaataaatcagaatcagagcgatacgaagcccacttccctcggtcagtccaactgcttttaaaataaagtatactgcaaccatggacatgaatgccgggaataatccaaggatcattgccagattcataaatgctttacgcattctaaagcgcagtcttgacatacagtaagatacactcagcacaaataccgtagagatcaaacatgaaaaaacggaaataatcagcgtatttataaaagctctcgggaagttcaacaatgttgtctccgtaaagagtctcttatagttattaaatgtcagttcttttgggaagaaatatgcggtatatgcaccactttcccctctcaaacttgtcatgataatccagaaaatcgggaataaccagatcactaccaggatggcaaggattatatgtaccaatgaattttttgcaattttctttgcccggccagcggtcatagggcgtttgcttacttttgcactgctcattacatgaatccctcctcatctttgtatgctttcgtatttctgtaggtgactaatgccacaatagaaagaactacgaatgttaagataccaatcacggcaccgatgttgtaatactgataatcgacggttaacttgtacagccatgttaccagcaagtctgtcttacctgcggtctctccgactggtgtaggctttcctgcagataacagatagataacgttaaagttattgatgttacctgtgaactgtgtaatgatataaggtcccataataaacataatatatggcaatgtaattttgcggaaaatctgtgcggcattggcaccatcaatcttggctgcctcatacaactctgccggtacattctgcaatacaccggtaacctgaagcatggtatatggaataccaacccagcagttaattaaaataaccgatacacgcgcccacatcgtattggtccagaatggaagcggattctggataagtccccactccatcagcaggttgttgatcgccccatgttcctgaagcatctgtctcataaccagtaaagatacaaactgtggtactgcaatggaaataacaaaacaggtacgccagaatgctttgcactttgtctctttgcggttgatgacaatcgcaaggatcagtcccaggaagttacataagaatgttgcacatactgcccagacaatggtccatcctaaaaccctccagaatgtcttgcctatctttccgccaagtccaagtaccgtcttaaagttcgccaatccaacccagtcaaataaggtcagatgcttgttgatcgtagaataattggtaaatgccattggaatcatgaataacaatggtaaaactgtaaaaataagaattcccatcaatgggagaaacattaatgtcttgtataaatttttatcaaataaacttttgacatccttgccaaaagaattgatttctttcccctcttttgcgaggcactctgccatatatgcgcttcttaaattttcagcccacatataaataaataaaagagtgatcgcaatcgtagcaacaccgtataacaacaataatacggaattgtcaccctgtacatactcatatatctgtttctgttcattaaatacctcttcctgttttctccatcctaatgaaggaagcatggaaagataatatgcacctgcattgaccataaacataatatagccaatctcaattgccaaaaaaattaaacctttgataatctgcttgtgggcgatgtttcccaatcccattataagcgctgataacttaactgcagccccgcccttcgtaagcgcattggatacagtgtacggtgtagcgaagtccgacttctttttgtttgcacctatcatacttatcctcccggcacatgttactctatgccatatttatagactcatgtattccaagattccggggaatccccagaaccttggaattgtttctctgtcttttccttttggaaaaagattactctgtaagtgagctgtttaactgctcgtttaatgcttctgtcttttccttagcattgtctgctgtgatctgtccttcagcaccgtgtacaaatgcatcaccgaatggtgtagctgcatcccagtaagcctgcattgggatgattggctgagcgatagagcaatttgttgctacgtttgccaaagctgatgcaactgcatccttagcaacttcttcgttagaaacaaggtttgtattaacaggagcctgctttcttaactcaaaatgctttaactgtgcgtcttcgcttcctaagtatgcagcaagcttaacagcaacttcctgattcttgcagttcgggttaacaccaatagccttagaaccaaggaatgccttcagctggcagtcttttccgtcaacgttgattgtaggaagggctgcaacaccaacgttctcctcaccaaggttcttaactactgcatcataattccagttaccattgaagtaagcatttacagatccatcctttaatccggcaagaccaagggatccttcgttattgtccattacgaaattcttgttgttgaataagtcaacaatgtactttgttactgctacagcgttgtctccgccgaagtcatatcccttagatgcatctgtaccatctccgaagattgtacatccgtttgctgcatagaaggaagcaagataccagccattgtcaaatgggaaagaaacttttcctttctcaagcattgtatcaaggctctttacatcatcttctgagaagactctcttatcataatacataaaccatgtatttggtgtataaggaacaccataaatatctccgttgtatgtaacagttgctgccatagcttctgggttggagctcttaacatattctgctacatctccaccgagctttgttaatgctccggcatcaaccagatcagcaatctggtcatttgcaaacatgtatacatccgctgcacttgcaggatcctgtaatacggtgtcttttgcatcagactctgaacatgttacatattcatatttaatgttccactccggatgttcctcgttaaatgcctcacactctgtctttaaccatgccccctgtgcatcatcctgatcctcggaaggtcccataacagtaagttttacatcaaccggttctgctgactcggaagtgcttccactgtttgctgcctgtgttccatcattagatgctccgttgtccttgctgccgcatccagcgaacattgtagctgtcattgctgcgacaagcattgctgctaatactttctttttcatcgttttcctctcctttttcaaaaatgatagttcaaaagtatctatataaaacgcctctgcgctctatatcgtaatttctgcgtcatctgcggtataccgccgcaagattccgtatccacgcccgacggctttccgcgagctgttctttgttcaatctccaccgccagttataacccacggtagacggtgcattcattcttgcctcgttcccgagcttcagcaaatcctgcatctgtatgaccgcgatgtctgcaatacttgcatatgcacaccggatcagtgcatccgggatttcttcctgactgctgatgttgagatattcatacagataagccagttcatattctgtcttgtccctgaaatatcctacaatcgtatcattgtcatgcgttcccgcgtataccactgtgtggcttcccggataattatgtggcagatgttcattggacggatctccgtcaaatgcaaacatcagaacttttgtgtccagccaccctgtctttgcaaggagttttttcactcccggtatcaatgccttgccgccgtaatcatcggcgatcactgttgttccattcaaaacggaattcaaagcgtcggtcagtttgcgccccggtcccttcatccaccgtccgcctgaagcatccgtggcatctttcggaaccatataatttttgacgaacccgatgaaatgatccatccggattacatcaaagagctttgtactgatctgcattcttcgtttccaccaggaaaacccatcctcctgcatgagaggccagttatacagtggatttccccatacctgacctgtttcggaaaacttatccggaattgcagctgccacataagcagcttcgccattctcatccagtaaaaactgttccggatgcatccaggtatccacgctgtcctttcccacataaaatggtacatctccgatcagctggattcctttgctgttggcatattccctaagttttccccactgctggaagaacttatattggcaaaacacccaaaacatgatgttattatacatctcttttcggcactttgcaagcgcaaccggttgttttttttgaatattttccggccagctctgccagttctggtttccattggatactttcagtgccatatacagtccataatcttcgacccagtccctgttttcttctacaaactgctgaaattccggttcgtgttcgtcaaaccggccaaatgctttctgcagaaccagcgtcctgttttcaaagagtgctgcataatcaatggcagatttctgtgttccccagtaatggctccggatttcctccggcgtcagaagcttttctctggcaagctgatccagatcaatcagataaggatttccggcaaatgccgacaagctctgatatgggctgtccccaaaacttgtaggtccgacaggaagcacctgccagtacttttgtttcagatccaccagcagatccacaaaatggaatgctgcatcacccagagtgccaataccatactctgacggtaggcttgatactgcaagaaggattccggaacctcttgctacttcctgtccttccaagattcttcaccccgtcttttaaatcacgaattctcctttggattattggaaaaaccatctaaaaatcttttcggattgtttcgtgttttttcgtatctgtcttaattttagtttctcttcgtcattttgtcaacgattttgcgttttcgggcaccattttccccacttttcacgtattttatatcgtgtttttgtacatattcacaacactattgctctgttttttcgaaactttttttgagaaagaattgcacagtttcccaaactgatttataatcatttaaacataaggaatcacaggagaaaatatatggctacaatcaaagatattgccaatcgtcttggagtttctgtaagcacagtctccaaaggtttaaacggcgcaagtgacataagtgatgagctgcggcagatggttctcgataccgctgtggagatgggatacagcaccaaacgttccaagaaagtggaaaaccgcaagctttgcattttcatagaaaacatgaattacgaaacaattgatgaattcggatatgacatagttctcggtttcaaacagaatgcgttccgccgcaaatgggatgttgatattctccccatcaccccggcatttcaggaagaggaaaaatacgatacctttctgttgaaaaacggctattgcggagcctttctgatgggtcttgcattgcatgattcctggatcaagcagctggaaaacactaccatgccaactgtgcttttggacaatttcatctccggaaatccaaatgtctgctatcttggaaccgacagctacgaaggcatcaccatggcagtaaatcatctggttaatctcgggcataaaaacattgcattcttaaacggttccttatactcactggtttctgaccagcggcaggaggcattcgaaagtgctatggctgctgcttcacttcctgtgcagaaggatctgacagcttacggctactatgtatccgacagtgccaaatatcatgttcccggatttctttccgccggtgccactgccgtggtctgcggcaatgacctgattgccaaaggggtcattgacgaatgtacgaagcgcggattccgcgtgccggaagacgtcagtgttgttggttttgacgacatatccattgctgccacttttgacccgccgcttaccacaatccgccaggaacgcaacgaacttggccgttgcgcttatgatattttaaattccctgatccatcacatcccgatcagcaaaacgctgctgcg
